United States Patent
Zhang et al.

(10) Patent No.: US 12,252,705 B2
(45) Date of Patent: Mar. 18, 2025

(54) SMALL TYPE II-D CAS PROTEINS AND METHODS OF USE THEREOF

(71) Applicants: THE BROAD INSTITUTE, INC., Cambridge, MA (US); MASSACHUSETTS INSTITUTE OF TECHNOLOGY, Cambridge, MA (US)

(72) Inventors: Feng Zhang, Cambridge, MA (US); Soumya Kannan, Cambridge, MA (US); Han Altae-Tran, Cambridge, MA (US)

(73) Assignees: THE BROAD INSTITUTE, INC., Cambridge, MA (US); MASSACHUSETTS INSTITUTE OF TECHNOLOGY, Cambridge, MA (US)

( * ) Notice: Subject to any disclaimer, the term of this patent is extended or adjusted under 35 U.S.C. 154(b) by 0 days.

(21) Appl. No.: 18/470,189

(22) Filed: Sep. 19, 2023

(65) Prior Publication Data

US 2024/0026382 A1 Jan. 25, 2024

Related U.S. Application Data

(63) Continuation of application No. 17/793,115, filed as application No. PCT/US2021/013753 on Jan. 15, 2021.

(60) Provisional application No. 62/962,672, filed on Jan. 17, 2020.

(51) Int. Cl.
| | | |
|---|---|---|
| *C12N 15/90* | (2006.01) | |
| *C12N 9/22* | (2006.01) | |
| *C12N 9/78* | (2006.01) | |
| *C12N 15/10* | (2006.01) | |

(52) U.S. Cl.
CPC .............. *C12N 15/90* (2013.01); *C12N 9/22* (2013.01); *C12N 9/78* (2013.01); *C12N 15/102* (2013.01); *C12Y 207/07049* (2013.01); *C12Y 305/04004* (2013.01); *C12Y 305/04005* (2013.01)

(58) Field of Classification Search
CPC . C12N 15/90; C12N 9/22; C12N 9/78; C12N 15/102; C12N 2310/20; C12N 9/1276; C12Y 207/07049; C12Y 305/04004; C12Y 305/04005; C07K 2319/00; C07K 2319/09
See application file for complete search history.

(56) References Cited

U.S. PATENT DOCUMENTS

| | | |
|---|---|---|
| 5,543,158 A | 8/1996 | Gref et al. |
| 5,563,055 A | 10/1996 | Townsend et al. |
| 5,855,913 A | 1/1999 | Hanes et al. |
| 5,985,309 A | 11/1999 | Edwards et al. |
| 6,007,845 A | 12/1999 | Domb et al. |
| 6,603,061 B1 | 8/2003 | Armstrong et al. |
| 7,206,639 B2 | 4/2007 | Jacobsen et al. |
| 7,868,149 B2 | 1/2011 | Boukharov et al. |
| 8,709,843 B2 | 4/2014 | Shakuda |
| 9,790,490 B2 | 10/2017 | Zhang et al. |
| 2005/0287127 A1 | 12/2005 | Li et al. |
| 2006/0030837 A1 | 2/2006 | Mckenna et al. |
| 2007/0093878 A1 | 4/2007 | Edge et al. |
| 2008/0267929 A1 | 10/2008 | Li et al. |
| 2009/0100536 A1 | 4/2009 | Adams et al. |
| 2011/0023139 A1 | 1/2011 | Weinstein et al. |
| 2011/0142917 A1 | 6/2011 | Alpert et al. |
| 2012/0159653 A1 | 6/2012 | Weinstein et al. |
| 2012/0328580 A1 | 12/2012 | Edge et al. |
| 2013/0183282 A1 | 7/2013 | Lemaire et al. |
| 2013/0185823 A1 | 7/2013 | Kuang et al. |
| 2013/0202678 A1 | 8/2013 | Yu et al. |
| 2014/0356867 A1 | 12/2014 | Peter et al. |
| 2018/0274017 A1 | 9/2018 | Abudayyeh et al. |
| 2018/0298445 A1 | 10/2018 | Abudayyeh et al. |
| 2018/0305773 A1 | 10/2018 | Abudayyeh et al. |
| 2019/0144929 A1 | 5/2019 | Abudayyeh et al. |
| 2019/0382800 A1* | 12/2019 | Severinov .............. C12N 15/63 |
| 2023/0340537 A1* | 10/2023 | Zhang ................... C12N 15/90 |

FOREIGN PATENT DOCUMENTS

| | | |
|---|---|---|
| WO | 2008/042156 A1 | 4/2008 |
| WO | 2008/076556 A2 | 6/2008 |
| WO | 2011/141027 A1 | 11/2011 |
| WO | 2013/176915 A1 | 11/2013 |
| WO | 2014/059173 A2 | 4/2014 |
| WO | 2014/066505 A1 | 5/2014 |

(Continued)

OTHER PUBLICATIONS

Gu et al. "Highly efficient base editing in *Staphylococcus aureus* using an engineered CRISPR RNA-guided cytidine deaminase." Chemical science 9.12 (2018): 3248-3253 (Year: 2018).*

(Continued)

*Primary Examiner* — Jeremy C Flinders
*Assistant Examiner* — Alexander W Nicol
(74) *Attorney, Agent, or Firm* — F. Brent Nix, Esq.; Johnson, Marcou, Isaacs & Nix, LLC

(57) ABSTRACT

Described herein are systems, methods, and compositions capable of targeting nucleic acids. Describe in certain exemplary embodiments herein are a class of small Cas proteins (Type II-D Cas proteins) and systems thereof. Also described in certain exemplary embodiments herein are methods of modifying target sequences using the class of small Cas proteins (Type II-D Cas proteins) and systems thereof described herein.

21 Claims, 1 Drawing Sheet
Specification includes a Sequence Listing.

(56) References Cited

FOREIGN PATENT DOCUMENTS

| | | |
|---|---|---|
| WO | 2014/093622 A2 | 6/2014 |
| WO | 2014/172606 A1 | 10/2014 |
| WO | 2014/184744 A1 | 11/2014 |
| WO | 2014/191128 A1 | 12/2014 |
| WO | 2014/204725 A1 | 12/2014 |
| WO | 2015/089419 A2 | 6/2015 |
| WO | 2015/105928 A1 | 7/2015 |
| WO | 2016/011210 A2 | 1/2016 |
| WO | 2016/106236 A1 | 6/2016 |
| WO | 2016/106244 A1 | 6/2016 |
| WO | 2016/149661 A1 | 9/2016 |
| WO | 2016/161516 A1 | 10/2016 |
| WO | 2016/205711 A1 | 12/2016 |
| WO | 2016/205749 A1 | 12/2016 |
| WO | 2016/205764 A1 | 12/2016 |
| WO | 2017/011804 A1 | 1/2017 |
| WO | 2017/070605 A1 | 4/2017 |
| WO | 2017/106657 A1 | 6/2017 |
| WO | 2017/127807 A1 | 7/2017 |
| WO | 2017/184768 A1 | 10/2017 |
| WO | 2017/184786 A1 | 10/2017 |
| WO | 2017/189308 A1 | 11/2017 |
| WO | 2017/218979 A1 | 12/2017 |
| WO | 2017/219027 A1 | 12/2017 |
| WO | 2018/007129 A1 | 1/2018 |
| WO | 2018/035387 A1 | 2/2018 |
| WO | 2018/035388 A1 | 2/2018 |
| WO | 2018/107129 A1 | 6/2018 |
| WO | 2018/170333 A1 | 9/2018 |
| WO | 2018/170340 A1 | 9/2018 |
| WO | 2018/180340 A1 | 10/2018 |
| WO | 2018/191388 A1 | 10/2018 |
| WO | 2018/194963 A1 | 10/2018 |
| WO | 2018/213708 A1 | 11/2018 |
| WO | 2018/213726 A1 | 11/2018 |
| WO | 2019/005866 A1 | 1/2019 |
| WO | 2019/005884 A1 | 1/2019 |
| WO | 2019/005886 A1 | 1/2019 |
| WO | 2019/018423 A1 | 1/2019 |
| WO | 2019/051318 A1 | 3/2019 |
| WO | 2019/060746 A1 | 3/2019 |
| WO | 2019/071048 A1 | 4/2019 |
| WO | 2019/071051 A1 | 4/2019 |
| WO | 2019/084063 A1 | 5/2019 |
| WO | 2019/126577 A2 | 6/2019 |
| WO | 2019/126709 A1 | 6/2019 |
| WO | 2019/126716 A1 | 6/2019 |
| WO | 2019/126762 A2 | 6/2019 |
| WO | 2019/126774 A1 | 6/2019 |
| WO | 2019/135816 A2 | 7/2019 |
| WO | 2019/148206 A1 | 8/2019 |
| WO | 2020/006036 A1 | 1/2020 |
| WO | 2020/006049 A1 | 1/2020 |
| WO | 2020/028555 A2 | 2/2020 |
| WO | 2020/033601 A1 | 2/2020 |
| WO | 2020/072816 A1 | 4/2020 |
| WO | 2020/102608 A2 | 5/2020 |
| WO | 2020/102610 A1 | 5/2020 |
| WO | 2021/146641 A1 | 7/2021 |

OTHER PUBLICATIONS

Tadic et al. "CRISPR/Cas9-based epigenome editing: an overview of dCas9-based tools with special emphasis on off-target activity." Methods 164 (2019): 109-119 (Year: 2019).*
Burstein, et al., "New CRISPR-Cas systems from uncultivated microbes," Nature, Feb. 9, 2017, vol. 542, No. 7640, all enclosed pages cited.
Hou, et al., "CRISPR-Cas systems in multicellular cyanobacteria," RNA Biology, Apr. 2019, vol. 16, No. 4, all enclosed pages cited.
International Search Report and Written Opinion for corresponding PCT application No. PCT/US2021/013753 mailed Apr. 21, 2021, all enclosed pages cited.
"International Preliminary Report on Patentability Chapter I received for International PCT Application Serial No. PCT/US2021/013753", mailed on Jul. 28, 2022, 8 pages.
Abudayyeh, et al., "A Cytosine Deaminase for Programmable Single-base RNA Editing", Science, vol. 365, Jul. 26, 2019, 382-386.
Abudayyeh, et al., "C2C2 is a Single-Component Programmable RNA-Guided RNA-Targeting CRISPR Effector", Science, vol. 353, No. 6299, Aug. 5, 2016, 23 pages.
Abudayyeh, et al., "Nucleic Acid Detection of Plant Genes Using CRISPR-Cas13", the CRISPR Journal, vol. 2, No. 3,, 2019, 165-171.
Abudayyeh, et al., "RNA targeting with CRISPR-Cas13", Nature, vol. 550., Oct. 12, 2017, 280-284.
Altschul, et al., "Basic Local Alignment Search Tool", Journal of Molecular Biology, vol. 215, May 15, 1990, 403-410.
Anzalone, et al., "Search-and-Replace Genome Editing Without Double-Strand Breaks or Donor DNA", Nature, vol. 576, Dec. 5, 2019, 149-157.
Banaszynski, et al., "A Rapid, Reversible, and Tunable Method to Regulate Protein Function in Living Cells Using Synthetic Small Molecules", Cell, vol. 126, Sep. 8, 2006, 995-1004.
Banaszynski, et al., "Chemical Control of Protein Stability and Function in Living Mice", Nature Medicine, vol. 14, No. 10, Oct. 2008, 1123-1127.
Belhaj, et al., "Plant Genome Editing Made Easy: Targeted Mutagenesis in Model and Crop Plants Using the CRISPR/Cas System", Plant Methods, vol. 9, No. 39, 2013, 10 pages.
Beumer, et al., "Donor DNA Utilization During Gene Targeting with Zinc-Finger Nucleases", Genes Genomes Genetics, vol. 3, Apr. 2013, 657-664.
Beumer, et al., "Efficient Gene Targeting in *Drosophila* by Direct Embryo Injection with Zinc-Finger Nucleases", PNAS, vol. 105, No. 50, Dec. 16, 2008, 19821-19826.
Biswas, et al., "CRISPRTarget Bioinformatic Prediction and Analysis of crRNA Targets", RNA Biology, vol. 10, No. 5, May 2013, 817-827.
Boni, et al., "Adoptive Transfer of Allogeneic Tumor-Specific T Cells Mediates Effective Regression of Large Tumors Across Major Histocompatibility Barriers", Blood, vol. 112, No. 12, Dec. 1, 2008, 4746-4754.
Bortolanza, et al., "AAV6-Mediated Systemic shRNA Delivery Reverses Disease in a Mouse Model of Facioscapulohumeral Muscular Dystrophy", Molecular Therapy, vol. 19, No. 11, Nov. 2011, 2055-2064.
Brooks, et al., "Efficient Gene Editing in Tomato in the First Generation Using the Clustered Regularly Interspaced Short Palindromic Repeats/CRISPR-Associated9 System", Plant Physiology, vol. 166, Nov. 2014, 1292-1297.
Caliando, et al., "Targeted DNA Degradation Using a CRISPR Device Stably Carried in the Host Genome", Nature Communications, vol. 6, No. 6989, May 19, 2015, 10 pages.
Cameron, et al., "Mapping the Genomic Landscape of CRISPR-Cas9 Cleavage", Nature Methods, May 1, 2017, 10 pages.
Canela, et al., "DNA Breaks and End Resection Measured Genome-Wide by End Sequencing", Molecular Cell, vol. 63, Sep. 1, 2016, 898-911.
Cartier, et al., "Hematopoietic Stem Cell Transplantation and Hematopoietic Stem Cell Gene Therapy in X-Linked Adrenoleukodystrophy", Brain Pathology, vol. 20, 2010, 857-862.
Casas, et al., "Transgenic Sorghum Plants via Microprojectile Bombardment", Proceedings of the National Academy of Sciences, vol. 90, Dec. 1993, 11212-11216.
Cavazzana, et al., "Outcomes of Gene Therapy for Severe Sickle Disease and Beta-Thalassemia Major Via Transplantation of Autologous Hematopoietic Stem Cells Transduced Ex Vivo with a Lentiviral Beta AT87Q-Globin Vector", Blood, vol. 126, No. 23, 2015, 4 pages.

(56) References Cited

OTHER PUBLICATIONS

Cavazzana-Calvo, et al., "Transfusion Independence and HMGA2 Activation After Gene Therapy of Human β-Thalassaemia", Nature, vol. 467, Sep. 16, 2010, 318-322.
Cekaite, et al., "Gene Expression Analysis in Blood Cells in Response to Unmodified and 2'-modified siRNAs Reveals TLR-Dependent and Independent Effects", Journal of Molecular Biology, vol. 365, 2007, 90-108.
Chapman, et al., "Playing the End Game: DNA Double-Strand Break Repair Pathway Choice", Molecular Cell, vol. 47, Aug. 24, 2012, 497-510.
Chen, et al., "Dynamic Imaging of Genomic Loci in Living Human Cells by an Optimized CRISPR/Cas System", Cell, vol. 155, Dec. 19, 2013, 1479-1491.
Chen, et al., "Efficient Labeling and Imaging of Protein-Coding Genes in Living Cells using CRISPR-Tag", Nature Communications, vol. 9, No. 5065, 2018, pp. 1-9.
Chen, et al., "Predicting Peptide-Mediated Interactions on a Genome-Wide Scale", PLOS Computational Biology, vol. 11, No. 5, May 4, 2015, 1-13.
Cheng, et al., "Casilio: a Versatile CRISPR-Cas9-Pumilio Hybrid for Gene Regulation and Genomic Labeling", Cell Research, vol. 26, 2016, pp. 254-257.
Cho, et al., "Rapid and Tunable Control of Protein Stability in Caenorhabditis Elegans Using a Small Molecule", Plos One, vol. 8, No. 8, e72393, Aug. 22, 2013, 1-5.
Choi, et al., "Targeted Genomic Rearrangements Using CRISPR/Cas Technology", Nature Communications. Vol. 5. No. 3728, 2014, 9 pages.
Chu, et al., "Efficient Generation of Rosa26 Knock-in Mice Using Crispr/cas9 in C57BL/6 Zygotes", BMC Biotechnology, vol. 16, No. 4, Jan. 16, 2016, 1-15.
Chung, et al., "Tunable and Reversible Drug Control of Protein Production Via a Self-excising Degron", Nature Chemical Biology, vol. 11, No. 9, Sep. 2015, 26 pages.
Ciccia, et al., "The DNA Damage Response: Making it Safe to Play with Knives", Molecular Cell, vol. 40, Oct. 22, 2010, 179-204.
Citorik, et al., "Sequence-Specific Antimicrobials Using Efficiently Delivered RNA-Guided Nucleases", Nature Biotechnology, vol. 32, No. 11, Nov. 2014, 18 pages.
Cox, et al., "RNA Editing with CRISPR-Cas13", Science, vol. 358, No. 6366, Nov. 24, 2017, 23 pages.
Crosetto, et al., "Nucleotide-Resolution DNA Double-Strand Break Mapping by Next-Generation Sequencing", Nature Methods, vol. 10, No. 4, Apr. 2013, 17 pages.
Davey, et al., "Direct DNA Transfer to Plant Cells", Plant Molecular Biology, vol. 13, 1989, 273-285.
Deng, et al., "CASFISH: CRISPR/Cas9-Mediated in Situ Labeling of Genomic Loci in Fixed Cells", PNAS, vol. 112, No. 38, Sep. 22, 2015, 11870-11875.
Dey, et al., "Toward a "Structural Blast": Using Structural Relationships to Infer Function", Protein Science, vol. 22, Jan. 24, 2013, 359-366.
Doench, et al., "Optimized sgRNA Design to Maximize Activity and Minimize Off-Target Effects of CRISPR-Cas9", Nature Biotechnology, vol. 34, No. 2, Feb. 2016, 35 pages.
Doench, et al., "Rational Design of Highly Active SgRNAs for CRISPR-Cas9-Mediated Gene Inactivation", Nature Biotechnology, vol. 32, No. 12, Dec. 2014, 17 pages.
Doman, et al., "Evaluation and Minimization of Cas9-Independent Off-target DNA Editing by Cytosine Base Editors", Nature Biotechnology, vol. 38, May 2020, 620-628.
Drakopoulou, et al., "The Ongoing Challenge of Hematopoietic Stem Cell-Based Gene Therapy for β-Thalassemia", Stem Cells International, vol. 2011, No. 987980, 2011, 1-10.
Dumonceaux, et al., "Combination of Myostatin Pathway Interference and Dystrophin Rescue Enhances Tetanic and Specific Force in Dystrophic mdx Mice", Molecular Therapy, vol. 18, No. 5, May 2010, 881-887.

Esvelt, et al., "Concerning RNA-Guided Gene Drives for the Alteration of Wild Populations", eLIFE, vol. 3, No. e03401, 2014, 1-21.
Esvelt, et al., "Orthogonal Cas9 Proteins for RNA-Guided Gene Regulation and Editing", Nature Methods, vol. 10, No. 11, Nov. 2013, 1116-1121.
Eulalio, et al., "Functional Screening Identifies MiRNAs Inducing Cardiac Regeneration", Nature, vol. 492, Dec. 20/27, 2012, 376-381.
Eyquem, et al., "Targeting a CAR to the TRAC Locus with CRISPR/Cas9 Enhances Tumour Rejection", Nature, vol. 543, Mar. 2, 2017, 113-117.
Feng, et al., "Efficient Genome Editing in Plants Using a CRISPR/Cas System", Cell Research, vol. 23, Aug. 2013, 1229-1232.
Frock, et al., "Genome-Wide Detection of DNA Double-Stranded Breaks Induced by Engineered Nucleases", Nature Biotechnology, vol. 33, No. 2, Feb. 2015, 179-186.
Fry, et al., "RNA Editing as a Therapeutic Approach for Retinal Gene Therapy Requiring Long Coding Sequences", International Journal of Molecular Sciences, vol. 21, No. 777, Jan. 25, 2020, 1-20.
Fu, et al., "CRISPR-dCas9 and sgRNA Scaffolds Enable Dual-Colour Live Imaging of Satellite Sequences and Repeat-Enriched Individual Loci", Nature Communications, vol. 7, No. 11707, May 25, 2016, pp. 1-8.
Fu, et al., "Linear Transgene Constructs Lacking Vector Backbone Sequences Generate Low-Copy-Number Transgenic Plants with Simple Integration Patterns", Transgenic Research, vol. 9, 2000, 11-19.
Fukui, Kenji, "DNA Mismatch Repair in Eukaryotes and Bacteria", Journal of Nucleic Acids, vol. 2010, No. 260512, Jun. 24, 2010, 1-16.
Gantz, et al., "Highly Efficient Cas9-Mediated Gene Drive for Population Modification of the Malaria Vector Mosquito Anopheles Stephensi", PNAS, Nov. 23, 2015, E6736-E6743.
Gao, et al., "Engineered Cpf1 Enzymes with Altered PAM Specificities", bioRxiv, Dec. 4, 2016, 17 pages.
Gaspar, et al., "Gene Therapy of X-Linked Severe Combined Immunodeficiency by Use of a Pseudotyped Gammaretroviral Vector", the Lancet, vol. 364, Dec. 18/25, 2004, 2181-2187.
Gaudelli, et al., "Programmable Base Editing of A·T to G·C in Genomic DNA without DNA Cleavage", Nature, vol. 551, No. 7681, Nov. 23, 2017, 37 pages.
Gleditzsch, et al., "Pam Identification by CRISPR-Cas Effector Complexes: Diversified Mechanisms and Structures", RNA Biology, vol. 16. No. 4, 2019, 504-517.
Gomaa, et al., "Programmable Removal of Bacterial Strains by Use of Genome-Targeting CRISPR-Cas Systems", mBio, vol. 5, No. 1, Jan./Feb. 2014, 1-9.
Gootenberg, et al., "Multiplexed and Portable Nucleic Acid Detection Platform with Cas13, Cas12a, and Csm6", Science, vol. 360, Apr. 27, 2018, 439-444.
Gootenberg, et al., "Nucleic Acid Detection with CRISPR-Cas13a/C2c2", Science, vol. 356, Apr. 28, 2017, 438-442.
Grissa, et al., "CRISPRFinder: a Web Tool to Identify Clustered Regularly Interspaced Short Palindromic Repeats", Nucleic Acids Research, vol. 35, 2007, W52-W57.
Grunebaum, et al., "Recent Advances in Understanding and Managing Adenosine Deaminase and Purine Nucleoside Phosphorylase Deficiencie", Current Opinion in Allergy and Clinical Immunology, vol. 13, No. 6, Dec. 2013, 630-638.
Gu, et al., "Transcription-Coupled Changes in Nuclear Mobility of Mammalian Cis-Regulatory Elements", Science, vol. 359, Mar. 2, 2018, pp. 1050-1055.
Hacein-Bey-Abina, et al., "Sustained Correction of X-Linked Severe Combined Immunodeficiency by Ex Vivo Gene Therapy", the New England Journal of Medicine, vol. 346, No. 16, Apr. 18, 2002, 1185-1193.
Hagstrom, et al., "A Facile Nonviral Method for Delivering Genes and siRNAs to Skeletal Muscle of Mammalian Limbs", Molecular Therapy, vol. 10, No. 2, Aug. 2004, 386-398.
Harris, et al., "RNA Editing Enzyme APOBEC1 and Some of Its Homologs Can Act as DNA Mutators", Molecular Cell, vol. 10, Nov. 2002, 1247-1253.

(56) References Cited

OTHER PUBLICATIONS

Hendel, et al., "Chemically Modified Guide RNAs Enhance CRISPR-Cas Genome Editing in Human Primary Cells", Nature Biotechnology, vol. 33, No. 9, Sep. 2015, 985-989.
Hsu, et al., "DNA Targeting Specificity of Rna-Guided Cas9 Nucleases", Nature Biotechnology, vol. 31, No. 9, Sep. 2013, 827-832.
Iacovoni, et al., "High-Resolution Profiling of yH2AX Around DNA Double Strand Breaks in the Mammalian Genome", the EMBO Journal, vol. 29, No. 8, 2010, 1446-1457.
Jiang, et al., "RNA-Guided Editing of Bacterial Genomes Using CRISPR-Cas Systems", Nature Biotechnology, vol. 31, No. 3, Mar. 2013, 233-239.
John, et al., "Existing and Emerging Technologies for Point-of-Care Testing", Clinical Biochemical Reviews, vol. 35, No. 3, 2014, 155-167.
Joung, et al., "Point-of-Care Testing for COVID-19 Using SHERLOCK Diagnostics", medRxiv, May 8, 2020, 21 pages.
Judge, et al., "Design of Noninflammatory Synthetic Sirna Mediating Potent Gene Silencing in Vivo", Molecular Therapy, vol. 13, No. 3, Mar. 2006, 494-505.
Jung, et al., "siRNA Targeting Hes5 Augments Hair Cell Regeneration in Aminoglycoside-Damaged Mouse Utricle", Molecular Therapy, vol. 21, No. 4, Apr. 2013, 834-841.
Katrekar, et al., "In Vivo RNA Editing of Point Mutations Via RNA-Guided Adenosine Deaminases", Nature Method, vol. 16, Mar. 2019, 239-242.
Kellner, et al., "Sherlock: Nucleic Acid Detection with CRISPR Nucleases", Nature Protocols, Spetember 23, 2019, 27 pages.
Kim, et al., "Digenome-Seq: Genome-Wide Profiling of CRISPR-Cas9 Off-Target Effects in Human Cells", Nature Methods, Feb. 9, 2015, 1-7.
Kim, et al., "Highly Efficient RNA-Guided Genome Editing in Human Cells via Delivery of Purified Cas9 Ribonucleoproteins", Genome Research, vol. 24, 2014, 1012-1019.
Kim, et al., "Increasing the Genome-Targeting Scope and Precision of Base Editing with Engineered Cas9-Cytidine Deaminase Fusions", Nature Biotechnology, vol. 35, No. 4, Apr. 2017, 371-376.
Kim, et al., "Structural and Kinetic Characterization of *Escherichia coli* TadA, the Wobble-Specific tRNA Deaminase", Biochemistry, vol. 45, Apr. 29, 2006, 6407-6416.
Kinouchi, et al., "Atelocollagen-Mediated Local and Systemic Applications of Myostatin-Targeting Sirna Increase Skeletal Muscle Mass", Gene Therapy, vol. 15, No. 15, 2008, 1126-1130.
Klein, et al., "High-Velocity Microprojectiles for Delivering Nucleic Acids into Living Cells. 1987", Biotechnology, vol. 24, 1992, 384-386.
Kleinstiver, et al., "Engineered Crispr-Cas9 Nucleases with Altered Pam Specificities", Nature, vol. 523, Jul. 23, 2015, 481-485.
Knight, et al., "Dynamics of CRISPR-Cas9 Genome Interrogation in Living Cells", Science, vol. 350, No. 6262, Nov. 13, 2015, pp. 823-826.
Komor, et al., "Programmable Editing of a Target Base in Genomic DNA without Double-Stranded DNA Cleavage", Nature, vol. 533, May 19, 2016, 420-424.
Kudla, et al., "High Guanine and Cytosine Content Increases mRNA Levels in Mammalian Cells", PLoS Biology, vol. 4, No. 6, e180, Jun. 2006, 0933-0942.
Leachman, et al., "First-in-Human Mutation-Targeted siRNA Phase Ib Trial of an Inherited Skin Disorder", Molecular Therapy, vol. 18, No. 2, Feb. 2010, 442-446.
Lee, et al., "Improved Ex Vivo Expansion of Adult Hematopoietic Stem Cells by Overcoming CUL4-Mediated Degradation of HOXB4", Blood, vol. 121, No. 20, May 16, 2013, 15 pages.
Lee, et al., "Monitoring of Dual CRISPR/Cas9-Mediated Steroidogenic Acute Regulatory Protein Gene Deletion and Cholesterol Accumulation Using High-Resolution Fluorescence in Situ Hybridization in a Single Cell", Frontiers in Endocrinology, vol. 8, No. 289, Oct. 25, 2017, 1-18.
Lee, et al., "Simultaneous Targeting of Linked Loci in Mouse Embryos Using Base Editing", Scientific Reports, vol. 9, No. 1662, 2019, 1-8.
Lee, et al., "Targeting Fidelity of Adenine and Cytosine Base Editors in Mouse Embryos", Nature Communications, vol. 9, No. 4804, 2018, 1-6.
Leenay, et al., "Identifying and Visualizing Functional Pam Diversity across Crispr-Cas Systems", Molecular Cell, vol. 62, No. 1, Apr. 7, 2016, 25 pages.
Lensing, et al., "DSBcapture: in Situ Capture and Sequencing of DNA Breaks", Nature Methods, vol. 13, No. 10, Oct. 2016, 17 pages.
Levy, et al., "Cytosine and Adenine Base Editing of the Brain, Liver, Retina, Heart and Skeletal Muscle of Mice via Adeno-Associated Viruses", Nature Biomedical Engineering, 2020, 18 pages.
Li, et al., "Base Editing with a Cpf1-Cytidine Deaminase Fusion", Nature Biotechnology, vol. 36, No. 4, Apr. 2018, 324-327.
Li, et al., "Generation of Novel AAV Variants by Directed Evolution for Improved CFTR Delivery to Human Ciliated Airway Epithelium", Molecular Therapy, vol. 17, No. 12, Dec. 2009, 2067-2077.
Lim, et al., "Treatment of a Mouse Model of ALS by in Vivo Base Editing", Molecular Therapy, vol. 28 No. 3, Mar. 2020, 1177-1189.
Liu, et al., "CRISPR-Cas9-mediated Multiplex Gene Editing in CAR-T Cells", Cell Research, vol. 27, 2017, 154-157.
Liu, et al., "Engineering Cell Signaling Using Tunable CRISPR-Cpf1-based Transcription Factors", Nature Communications, vol. 8, No. 2095, Dec. 13, 2017, 1-8.
Ma, et al., "CRISPR-Cas9 nuclear dynamics and target recognition in living cells", Journal of Cell Biology, vol. 214, No. 5, 2016, pp. 529-537.
Ma, et al., "CRISPR-Sirius: RNA Scaffolds for Signal Amplification in Genome Imaging", Nature Methods, vol. 15, No. 11, Nov. 2018, 13 pages.
Ma, et al., "Live Visualization of HIV-1 Proviral DNA Using a Dual-Color-Labeled CRISPR System", Analytical Chemistry, 2017, 18 pages.
Ma, et al., "Multicolor CRISPR Labeling of Chromosomal Loci in Human Cells", PNAS, vol. 112, No. 10, Mar. 10, 2015, 3002-3007.
Ma, et al., "Multiplexed Labeling of Genomic Loci with dCas9 and Engineered sgRNAs using CRISPRainbow", Nature Biotechnology, Apr. 18, 2016, 1-3.
Makarova, et al., "Evolutionary Classification of CRISPR-Cas Systems: a Burst of Class 2 and Derived Variants", Nature Reviews Microbiology, vol. 18, Feb. 2020, 67-83.
Marraffini, et al., "Self Vs. Non-Self Discrimination During CRISPR RNA-Directed Immunity", Nature, vol. 463, No. 7280, Jan. 28, 2010, 13 pages.
Maynard-Smith, et al., "A Directed Approach for Engineering Conditional Protein Stability Using Biologically Silent Small Molecules", the Journal of Biological Chemistry, vol. 282, No. 34, Aug. 24, 2007, 24866-24872.
Miyazaki, et al., "Destabilizing Domains Derived from the Human Estrogen Receptor", Journal of the American Chemical Society, vol. 134, Feb. 14, 2012, 3942-3945.
Mojica, et al., "Short Motif Sequences Determine the Targets of the Prokaryotic CRISPR Defence System", Microbiology, vol. 155, 2009, 733-740.
Molitoris, et al., "siRNA Targeted to p53 Attenuates Ischemic and Cisplatin-Induced Acute Kidney Injury", Journal of the American Society of Nephrology, vol. 20, 2009, 1754-1764.
Montiel-Gonzalez, et al., "Correction of Mutations within the Cystic Fibrosis Transmembrane Conductance Regulator by Site-Directed RNA Editing", PNAS, vol. 110, No. 45, Nov. 5, 2013, 18285-18290.
Morrell, et al., "Crop Genomics: Advances and Applications", Nature Reviews Genetics, vol. 13, Feb. 2012, 85-96.
Mukherjea, et al., "Transtympanic Administration of Short Interfering (si)RNA for the NOX3 Isoform of NADPH Oxidase Protects Against Cisplatin-Induced Hearing Loss in the Rat", Antioxidants & Redox Signaling, vol. 13, No. 5, 2010, 589-598.
Myrvhold, et al., "Field-deployable Viral Diagnostics using CRISPR-Cas13", Science, vol. 360, Apr. 27, 2018, 444-448.

(56) References Cited

OTHER PUBLICATIONS

Nakagawa, et al., "Generation of Induced Pluripotent Stem Cells Without Myc from Mouse and Human Fibroblasts", Nature Biotechnology, vol. 26, No. 1, Jan. 2008, 101-106.
Nienhuis, et al., "Development of Gene Therapy for Thalassemia", Cold Spring Harbor Perspectives in Medicine, vol. 2, No. a011833, Nov. 2012, 1-17.
Nishida, et al., "Targeted Nucleotide Editing Using Hybrid Prokaryotic and Vertebrate Adaptive Immune Systems", Science, 2016, 14 pages.
Nishimasu, et al., "Crystal Structure of Cas9 in Complex With Guide RNA and Target DNA", Cell, vol. 156, Feb. 27, 2014, 935-949.
Okita, et al., "Generation of Germline-Competent Induced Pluripotent Stem Cells", Nature, vol. 448, No. 7151, Jul. 19, 2007, 313-318.
Orthwein, et al., "A Mechanism for the Suppression of Homologous Recombination in G1 Cells", Nature, vol. 528, No. 7582, Dec. 17, 2015, 35 pages.
Paix, et al., "High Efficiency, Homology-Directed Genome Editing in Caenorhabditis Elegans using CRISPR-Cas9 Ribonucleoprotein Complexes", Genetics, vol. 201, Sep. 2015, 47-54.
Pattanayak, et al., "High-Throughput Profiling of Off-Target DNA Cleavage Reveals RNA-Programmed Cas9 Nuclease Specificity", Nature biotechnology, vol. 31, No. 9, Sep. 2013, 16 pages.
Phelps, et al., "Recognition of Duplex RNA by the Deaminase Domain of the RNA Editing Enzyme ADAR2", Nucleic Acids Research, vol. 43, No. 2, 2015, 1123-1132.
Qi, et al., "Efficient siRNA Transfection to the Inner Ear Through the Intact Round Window by a Novel Proteidic Delivery Technology in the Chinchilla", Gene Therapy, vol. 21, 2014, 10-18.
Qu, et al., "Leveraging Endogenous ADAR for Programmable Editing on RNA", BioRxiv, Apr. 19, 2019, 46 pages.
Qui, et al., "Mutation Detection Using SurveyorTM Nuclease", Biotechniques, vol. 36, No. 4, Apr. 2004, 702-707.
Rahdar, et al., "Synthetic CRISPR RNA-Cas9-guided Genome Editing in Human Cells", PNAS, Nov. 16, 2015, E7110-E7117.
Ran, et al., "Double Nicking by RNA-Guided CRISPR Cas9 for Enhanced Genome Editing Specificity", Cell, vol. 154, No. 6, Sep. 12, 2013, 19 pages.
Ran, et al., "In Vivo Genome Editing using *Staphylococcus Aureus* Cas9", Nature, 2015, 30 pages.
Rees, et al., "Base Editing: Precision Chemistry on the Genome and Transcriptome of Living Cells", Nature Reviews Genetics, vol. 19, No. 12, Dec. 2018, 41 pages.
Rejali, et al., "Cochlear Implants and Ex Vivo BDNF Gene Therapy Protect Spiral Ganglion Neurons", Hearing Research, vol. 228, No. 1-2, Jun. 2007, 14 pages.
Richter, et al., "Phage-assisted Evolution of an Adenine Base Editor with Improved Cas Domain Compatibility and Activity", Nature Biotechnology, 2020, 18 pages.
Rodriguez, et al., "Targeted Chemical-Genetic Regulation of Protein Stability in Vivo", Chemistry & Biology, vol. 19, Mar. 23, 2012, 391-398.
Rupp, et al., "CRISPR/Cas9-mediated PD-1 Disruption Enhances Anti-tumor Efficacy of Human Chimeric Antigen Receptor T Cells", Scientific Reports, vol. 7, No. 737, Apr. 7, 2017, 1-10.
Ryu, et al., "Adenine Base Editing in Mouse Embryos and an Adult Mouse Model of Duchenne Muscular Dystrophy", Nature Biotechnology, vol. 36, No. 6, Jun. 2018, 536-539.
Salt, et al., "Local Inner-Ear Drug Delivery and Pharmacokinetics", Drug Discovery Today, vol. 10, No. 19, Oct. 1, 2005, 14 pages.
Savva, et al., "The ADAR Protein Family", Genome Biology, vol. 13, No. 252, 2012, 1-10.
Schene, et al., "Prime Editing for Functional Repair in Patient-Derived Disease Models", Nature Communications, vol. 11, No. 5352, 2020, 1-8.
Shan, et al., "Targeted Genome Modification of Crop Plants Using a CRISPR-Cas System", Nature Biotechnology, vol. 31, No. 8, Aug. 2013, 686-688.
Shao, et al., "Long-Term Dual-Color Tracking of Genomic Loci by Modified sgRNAs of the CRISPR/Cas9 System", Nucleic Acids Research, vol. 44, No. 9, e86, Feb. 4, 2016, 1-13.
Shao, et al., "Multiplexed sgRNA Expression Allows Versatile Single Nonrepetitive DNA Labeling and Endogenous Gene Regulation", ACS Synthetic Biology, vol. 7, 2018, 176-186.
Shmakov, et al., "Discovery and Functional Characterization of Diverse Class 2 CRISPR-Cas Systems", Molecular Cell, vol. 60, Nov. 5, 2015, 1-13.
Shmakov, et al., "Diversity and evolution of class 2 CRISPR-Cas systems", Nature Reviews Microbiology, vol. 15, Mar. 2017, 169-182.
Sinnamon, et al., "Site-directed RNA Repair of Endogenous Mecp2 RNA in Neurons", PNAS, Oct. 16, 2017, E9395-9402.
Slaymaker, et al., "Rationally Engineered Cas9 Nucleases with Improved Specificity", Science, vol. 351, No. 6268, Jan. 1, 2016, 84-88.
Smargon, et al., "Cas13b Is a Type VI-B CRISPR-Associated RNA-Guided RNase Differentially Regulated by Accessory Proteins Csx27 and Csx28", Molecular Cell, vol. 65, Feb. 16, 2017, 618-630.
Somasuntharam, et al., "Delivery of Nox2-NADPH Oxidase Sirna with Polyketal Nanoparticles for Improving Cardiac Function Following Myocardial Infarction", Biomaterials, vol. 34, No. 31, Oct. 2013, 19 pages.
Song, et al., "Improved Hematopoietic Differentiation Efficiency of Gene-Corrected Beta-Thalassemia Induced Pluripotent Stem Cells by CRISPR/Cas9 System", Stem Cells and Development, vol. 24, No. 9, 2015, 1053-1065.
Strich, et al., "CRISPR-Cas Biology and Its Application to Infectious Diseases", Journal of Clinical Microbiology, vol. 57, No. 4, e01307-18, Apr. 2019, 1-14.
Suzuki, et al., "In Vivo Genome Editing Via CRISPR/Cas9 Mediated Homology-Independent Targeted Integration", Nature, vol. 540, Dec. 2016, 144-149.
Szilard, et al., "Systematic Identification of Fragile Sites Via Genome-wide Location Analysis of y-h2Ax", Nature Structural & Molecular Biology, vol. 17, No. 3, Mar. 2010, 21 pages.
Takahashi, et al., "Induction of Pluripotent Stem Cells from Adult Human Fibroblasts by Defined Factors", Cell, vol. 131, Nov. 30, 2007, 861-872.
Takahashi, et al., "Induction of Pluripotent Stem Cells from Mouse Embryonic and Adult Fibroblast Cultures by Defined Factors", Cell, vol. 126, Aug. 25, 2006, 663-676.
Tanenbaum, et al., "A Protein-Tagging System for Signal Amplification in Gene Expression and Fluorescence Imaging", Cell, vol. 159, Oct. 23, 2014, 635-646.
Thuronyi, et al., "Continuous Evolution of Base Editors with Expanded Target Compatibility and Improved Activity", Nature Biotechnology, vol. 37, No. 9, Sep. 2019, 30 pages.
Tsai, et al., "Circle-Seq: a Highly Sensitive in Vitro Screen for Genome-wide CRISPR-Cas9 Nuclease Off-targets", Nature Methods, vol. 14, No. 6, Jun. 2017, 19 pages.
Tsai, et al., "Dimeric CRISPR RNA-Guided FokI Nucleases for Highly Specific Genome Editing", Nature Biotechnology, vol. 32, No. 6, Jun. 2014, 569-576.
Tsai, et al., "Guide-seq Enables Genome-wide Profiling of Off-target Cleavage by Crispr-cas Nucleases", Nature Biotechnology, vol. 33, No. 2, Feb. 2015, 187-197.
Wahlgren, et al., "Plasma Exosomes can Deliver Exogenous Short Interfering RNA to Monocytes and Lymphocytes", Nucleic Acid Research, vol. 40, No. 17, e130, May 22, 2012, 1-12.
Wang, et al., "An RNA-Aptamer-Based Two-Color CRISPR Labeling System", Scientific Reports, vol. 6, No. 26857, May 27, 2016, pp. 1-7.
Wang, et al., "CRISPR-Mediated Live Imaging of Genome Editing and Transcription", Science, Sep. 5, 2019, 1-8.
Wang, et al., "One-Step Generation of Mice Carrying Mutations in Multiple Genes by CRISPR/Cas-Mediated Genome Engineering", Cell, vol. 153, May 9, 2013, 910-918.
Wang, et al., "RNA-Guided Endonuclease Provides a Therapeutic Strategy to Cure Latent Herpesviridae Infection", PNAS, vol. 111, No. 36, Sep. 9, 2014, 13157-13162.

(56) References Cited

OTHER PUBLICATIONS

Wang, et al., "Unbiased Detection of off-target Cleavage by CRIScrisPR-Cas9 and TALENs Using Integrase-Defective Lentiviral Vectors", Nature Biotechnology, vol. 33, No. 2, Feb. 2015, 175-179.
Watts, et al., "Hematopoietic Stem Cell Expansion and Gene Therapy", Cytotherapy, vol. 13, No. 10, Nov. 2011, 13 pages.
Wechsler, et al., "ZFN-Mediated Gene Targeting at the Albumin Locus in Liver Results in Therapeutic Levels of Human Fix in Mice and Non-Human Primates", Blood, vol. 126, No. 23, 2015, 2 pages.
Weiss, et al., "Optimization of Multiplexed CRISPR/Cas9 System for Highly Efficient Genome Editing in Setaria Viridis", Biorxiv, Apr. 12, 2020, 42 pages.
Wettengel, et al., "Harnessing Human ADAR2 for RNA Repair—Recoding a PINK1 Mutation Rescues Mitophagy", Nucleic Acids Research, vol. 45, No. 5, 2017, 2797-2808.
Wolf, et al., "tadA, an Essential tRNA-Specific Adenosine Deaminase from *Escherichia coli*", the EMBO Journal, vol. 21, No. 14, 2002, 3841-3851.
Woo, et al., "DNA-Free Genome Editing in Plants with Preassembled CRISPR-Cas9 Ribonucleoproteins", Nature Biotechnology, vol. 33, No. 11, Nov. 2015, 1162-1164.
Wu, et al., "A CRISPR/molecular Beacon Hybrid System for Live-Cell Genomic Imaging", Nucleic Acids Research, vol. 46, No. 13, Apr. 30, 2018, e80-1-e80-10.
Wu, et al., "Correction of a Genetic Disease by CRISPR-Cas9-Mediated Gene Editing in Mouse Spermatogonial Stem Cells", Cell Research, vol. 25, 2015, 67-79.
Wu, et al., "Correction of a Genetic Disease in Mouse via Use of CRISPR-Cas9", Cell Stem Cell, vol. 13, Dec. 5, 2013, 659-662.
Xie, et al., "RNA-Guided Genome Editing in Plants Using a CRISPR-Cas System", Molecular Plant, vol. 6, No. 6, Nov. 2013, 1975-1983.
Xie, et al., "Seamless Gene Correction of B-Thalassemia Mutations in Patient-Specific Ipscs Using CRISPR/Cas9 and Piggybac", Genome Research, vol. 24, 2014, 1526-1533.
Xu, et al., "Both TALENs and CRISPR/Cas9 Directly Target the HBB IVS2-654 (C>T) Mutation in β-Thalassemia-Derived iPSCs", Scientific Reports, vol. 5, No. 12065, 2015, 15 pages.
Xu, et al., "Gene Targeting Using the Agrobacterium Tumefaciens-Mediated CRISPR-Cas System in Rice", Rice, vol. 7, No. 5, 2014, 1-4.
Yan, et al., "Bliss: Quantitative and Versatile Genome-wide Profiling of DNA Breaks in Situ", BioRxiv, retrieved as on Oct. 15, 2020:—"doi: https://doi.org/10.1101/091629", Dec. 4, 2016, 23 pages.
Yang, et al., "A Myocardium Tropic Adeno-Associated Virus (AAV) Evolved by DNA Shuffling and in Vivo Selection", PNAS, vol. 106, No. 10, Mar. 10, 2009, 3946-3951.
Yang, et al., "Engineering and Optimising Deaminase Fusions for Genome Editing", Nature Communications, vol. 7, No. 13330, Nov. 2, 2016, 1-11.
Yang, et al., "Genome-Wide Inactivation of Porcine Endogenous Retroviruses (PERVs)", Science, vol. 350, No. 6264, Nov. 27, 2015, 1101-1104.
Yang, et al., "Methods Favoring Homology-Directed Repair Choice in Response to CRISPR/Cas9 Induced-Double Strand Breaks", International Journal of Molecular Sciences, vol. 21, No. 6461, Sep. 4, 2020, 1-20.
Ye, et al., "Live Cell Imaging of Genomic Loci using dCas9-SunTag System and a Bright Fluorescent Protein", Protein Cell, vol. 8, No. 11, 2017, pp. 853-855.
Ye, et al., "Seamless Modification of Wild-Type Induced Pluripotent Stem Cells to the Natural CCR5Δ32 Mutation Confers Resistance to HIV Infection", PNAS, vol. 111, No. 26, Jul. 1, 2014, 9591-9596.
Yin, et al., "Therapeutic Genome Editing by Combined Viral and Non-Viral Delivery of CRISPR System Components in Vivo", Nature Biotechnology, vol. 34, No. 3, Mar. 2016, 328-333.
Yu, et al., "Induced Pluripotent Stem Cell Lines Derived From Human Somatic Cells", Science, vol. 318, Dec. 21, 2007, 1917-1920.
Zaehres, et al., "Induction of Pluripotency: From Mouse to Human", Cell, vol. 131, Nov. 30, 2007, 834-835.
Zetche, et al., "A Split Cas9 Architecture for Inducible Genome Editing and Transcription Modulation", Nature Biotechnology, vol. 33, No. 2, Feb. 2015, 6 pages.
Zetsche, et al., "Cpf1 is a Single RNA-Guided Endonuclease of a Class 2 CRISPR-Cas System", Cell, vol. 163, Oct. 22, 2015, 759-771.
Zhang, et al., "Global Non-Viral Gene Transfer to the Primate Brain Following Intravenous Administration", Molecular Therapy, vol. 7, No. 1, Jan. 2003, 11-18.
Zhang, et al., "Structure-Based Prediction of Protein-Protein Interactions on a Genome-Wide Scale", Nature, vol. 490, Oct. 25, 2012, 556-560.
Zhao, et al., "Single-Molecule Detection and Tracking of RNA Transcripts in Living Cells using Phosphorothioate-Optimized 2'-O-methyl RNA Molecular Beacons", Biomaterials, vol. 100, 2016, pp. 172-183.
Zheng, et al., "Topical Delivery of siRNA-Based Spherical Nucleic Acid Nanoparticle Conjugates for Gene Regulation", PNAS, vol. 109, No. 30, Jul. 24, 2012, 11975-11980.
Zhong, et al., "CPF1 Proteins Excise CRISPR RNAs from mRNA Transcripts in Mammalian Cells", Nature Chemical Biology, vol. 13, No. 8, Aug. 2017, 11 pages.
Zhou, et al., "Exploiting SNPs for Biallelic CRISPR Mutations in the Outcrossing Woody Perennial Populus Reveals 4-coumarate:CoA ligase Specificity and Redundancy", New Phytologist, vol. 208, 2015, 298-301.
Zuckermann, et al., "Somatic CRISPR/Cas9-Mediated Tumour Suppressor Disruption Enables Versatile Brain Tumour Modelling", Nature Communications, vol. 6, No. 7391, Jun. 11, 2015, 1-9.
Zuris, et al., "Efficient Delivery of Genome-Editing Proteins in Vitro and in Vivo", Nature Biotechnology, vol. 33, No. 1, Jan. 2015, 26 pages.
Liu, et al., "Engineering cell signaling using tunable CRISPR-Cpf1-based transcription factors," Nature Communications, 8:2095, 2017, DOI: 10.1038/s41467-017-02265-x, all enclosed pages cited.
Restriction Requirement from corresponding U.S. Appl. No. 17/793,115 mailed Jul. 30, 2024, all enclosed pages cited.
Restriction Requirement from corresponding U.S. Appl. No. 17/793,115 mailed Dec. 5, 2024, all enclosed pages cited.

\* cited by examiner

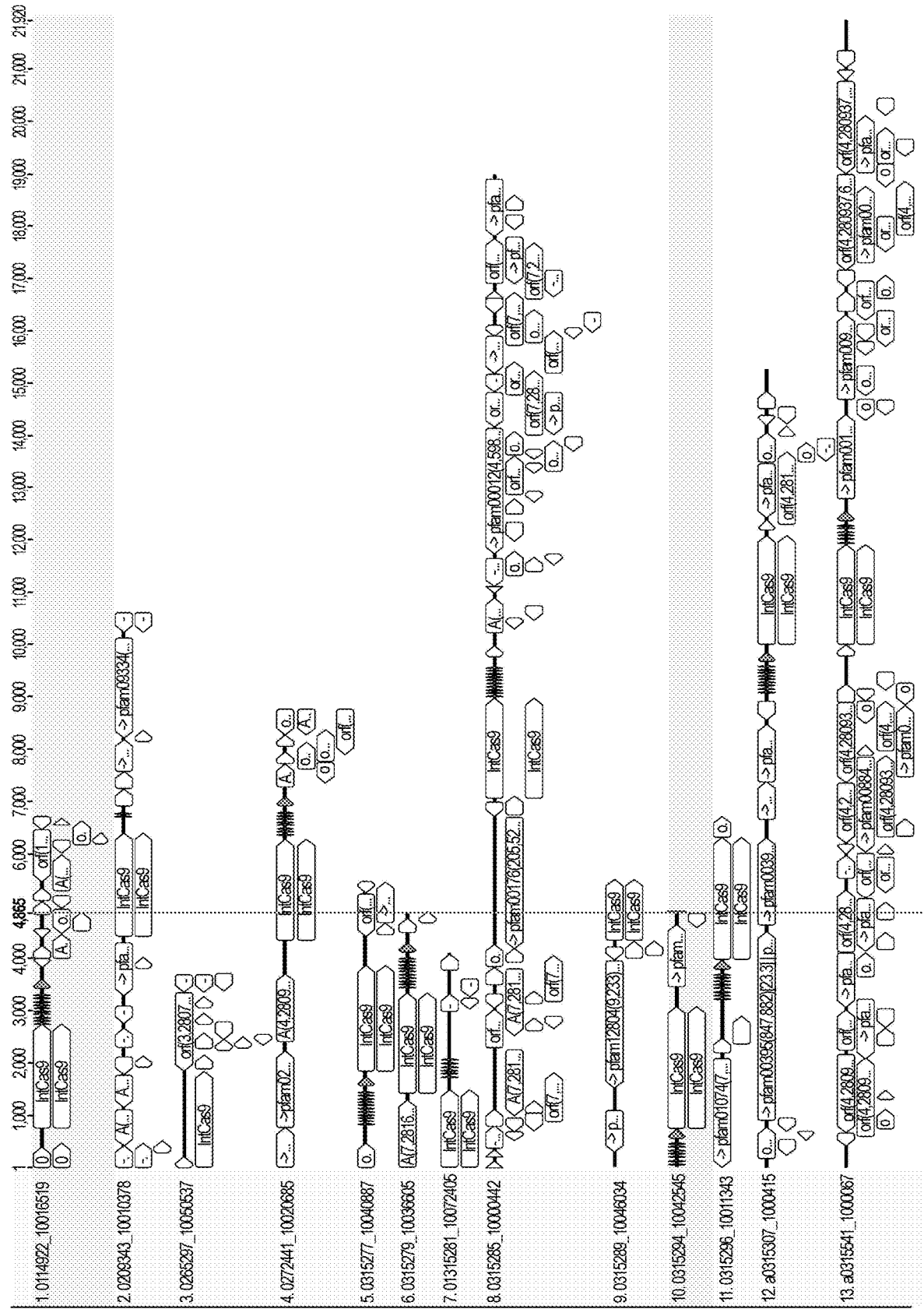

US 12,252,705 B2

SMALL TYPE II-D CAS PROTEINS AND METHODS OF USE THEREOF

CROSS-REFERENCE TO RELATED APPLICATIONS

This application is a continuation of U.S. application Ser. No. 17/793,115, filed Jul. 15, 2022, which is the U.S. National Stage Application under 35 U.S.C. § 371 of Patent Cooperation Treaty Application No.: PCT/US2021/013753, filed on Jan. 15, 2021, which claims the benefit of U.S. Provisional Application No. 62/962,672 filed Jan. 17, 2020. The entire contents of the above-identified applications are hereby fully incorporated herein by reference.

STATEMENT REGARDING FEDERALLY SPONSORED RESEARCH

This invention was made with government support under Grant No. HL141201 awarded by the National Institutes of Health. The government has certain rights in the invention.

SEQUENCE LISTING

The contents of the electronic sequence listing ("BROD-5020US-CON_ST26.xml"; Size is 820,851 bytes and it was created on Sep. 19, 2023) is herein incorporated by reference in its entirety.

TECHNICAL FIELD

The subject matter disclosed herein is generally directed to compositions, systems, and methods of modifying target polynucleotides. Such compositions and systems include Clustered Regularly Interspaced Short Palindromic Repeats (CRISPR) and other Cas-based systems or components thereof.

BACKGROUND

Recent advances in genome sequencing techniques and analysis methods have significantly accelerated the ability to catalog and map genetic factors associated with a diverse range of biological functions and diseases. Precise genome targeting technologies are needed to enable systematic reverse engineering of causal genetic variations by allowing selective perturbation of individual genetic elements, as well as to advance synthetic biology, biotechnological, and medical applications. Although genome-editing techniques such as designer zinc fingers, transcription activator-like effectors (TALEs), homing meganucleases, and CRISPR-Cas systems are available for producing targeted genome perturbations, there remains a need for new genome engineering technologies that employ new and/or improved strategies and molecular mechanisms and are affordable, easy to set up, scalable, and amenable to targeting multiple positions within the eukaryotic and other genomes. This would provide a major resource for new applications in genome engineering and biotechnology.

Citation or identification of any document in this application is not an admission that such a document is available as prior art to the present invention.

SUMMARY

Described in exemplary embodiments herein are engineered nucleic acid targeting systems comprising a Cas protein comprising a RuvC domain and an HNH domain, wherein the Cas protein is about 950 amino acids or less in size, wherein the Cas protein is capable of forming a complex with a nucleic acid guide molecule, and wherein the nucleic acid guide molecule is capable of sequence-specific binding of a target nucleic acid sequence on a target polynucleotide.

In certain example embodiments, the Cas protein is less than or equal to 780 amino acids in size.

In certain example embodiments, the Cas protein has no association with Cas1, Cas2, Cas4, or Csn2.

In certain example embodiments, the Cas protein is a Type II Cas protein.

In certain example embodiments, the Type II Cas protein is a Type II-D Cas protein.

In certain example embodiments, the Cas protein is encoded at least in part or in whole by a polynucleotide sequence that is about 70-100 percent identical to any one of SEQ ID NOs: 31-133 or a portion thereof.

In certain example embodiments, the Cas protein is encoded at least in part or in whole by a polynucleotide sequence that is about 70-100 percent identical to any one of SEQ ID NOs: SEQ ID NOs: 31, 37, 39, 40, 44, 49, 55, 57, 63, 64, 68, 70, 76, and 80-133 or a portion thereof.

In some embodiments, the Cas protein is from or originated from Gammaproteobacteria bacterium AqS3, Deltaproteobacteria bacterium GWF2_42_12, JGI Metagenome: IMG 3300025323, Nitrospirae bacterium RBG_13_39_12, or Nitrospiraceae bacterium isolate UBA9935.

In certain example embodiments, the Cas protein is capable of forming a complex with two or more nucleic guide molecules, wherein each guide molecule is capable of sequence-specific binding of a target nucleic acid sequence, wherein each target sequence is different.

In certain example embodiments, the target sequences are on the same or are on different target polynucleotides.

In certain example embodiments, the guide molecule or the two or more guide molecules are capable of sequence-specific binding a target sequence in vitro, in situ, ex vivo, or in vivo.

In certain example embodiments, the guide molecule or the two or more guide molecules are capable of sequence-specific binding a target sequence in a prokaryotic cell, eukaryotic cell, a virus, or a combination thereof.

In certain example embodiments, the Cas protein is operably coupled to one or more nuclear localization signals.

In certain example embodiments, the Cas protein is operably coupled to one or more nuclear export signals.

In certain example embodiments, the Cas protein lacks one or more catalytic activates.

In certain example embodiments, the Cas protein lacks nuclease activity.

In certain example embodiments, the Cas protein is a nickase.

In certain example embodiments, the Cas protein is operably coupled to or associated with one or more functional domains.

In certain example embodiments, the one or more functional domains is/are one or more heterologous functional domains.

In certain example embodiments, the one or more functional domains has one or more activities selected from deaminase activity, methylase activity, demethylase activity, transcription activation activity, transcription repression activity, transcription release factor activity, histone modification activity, nuclease activity, single-strand RNA cleavage activity, double-strand RNA cleavage activity, single-strand DNA cleavage activity, double-strand DNA cleavage activity, nucleic acid binding activity, transposition activity, reverse transcription activity, or a combination thereof.

In certain example embodiments, the one or more functional domains is/are capable of cleaving the target polynucleotide.

In certain example embodiments, the one or more functional domains is capable of modifying transcription or translation of the target polynucleotide.

In certain example embodiments, the engineered nucleic acid targeting system further comprises a recombination template.

In certain example embodiments, the recombination template is operably coupled to, complexed with, or is associated with the Cas protein, the nucleic acid guide molecule, or both.

In certain example embodiments, the recombination template is a homology-directed repair (HDR) recombination template.

In certain example embodiments, the nucleic acid targeting system comprises a tracrRNA.

In certain example embodiments, the Cas protein is a chimeric protein comprising a first polypeptide fragment from a first Cas protein and a second polypeptide fragment from a second Cas protein.

In certain example embodiments, the engineered nucleic acid targeting system further comprises a deaminase or catalytic domain thereof.

In certain example embodiments, the deaminase is an adenosine deaminase or a cytidine deaminase.

In certain example embodiments, the deaminase or catalytic domain thereof is operably coupled to, complexed with, or otherwise associated with the Cas protein, a guide molecule, or both or is capable of operably coupling to, complexing with, or otherwise associated with the Cas protein, a guide molecule, or both after delivery to a cell.

In certain example embodiments, the nucleotide deaminase or catalytic domain thereof has been modified to increase its activity against a DNA-RNA heteroduplex, to reduce off-target effects, or both.

In certain example embodiments, the engineered nucleic acid targeting system further comprises a reverse transcriptase or functional domain thereof, wherein the reverse transcriptase or functional domain thereof is optionally operably coupled to, is capable of complexing with, or is otherwise associated with the Cas protein, the guide molecule, or both.

In certain example embodiments, the engineered nucleic acid targeting system further comprises one or more nucleic acid guide molecules, wherein each of the one or more nucleic acid guide molecules is capable of capable of forming a complex or is complexed with the Cas protein, and wherein each of the one or more nucleic acid guide molecules is capable of sequence specific binding of a target sequence in a target polynucleotide.

In certain example embodiments, the engineered nucleic acid targeting system is capable of modifying a sequence of the target polynucleotide.

In certain example embodiments, the modification is
a. insertion of one or more polynucleotides;
b. deletion of one or more polynucleotides;
c. conversion of a C•G base pair to a T•A base pair;
d. conversion of an A•T base pair to a G•C base pair;
e. or a combination thereof.

In certain example embodiments, the modification alters a transcription product of the target polynucleotide, a translation product of the target polynucleotide, or both.

In certain example embodiments, the modification alters transcription, translation, or both of the target polynucleotide.

Described in certain example embodiments herein are polynucleotides comprising one or more nucleic acid sequences that encode one or more components of the engineered nucleic acid system of any one of preceding paragraphs or described in greater detail elsewhere herein.

In certain example embodiments, the polynucleotide is codon optimized for expression in a eukaryotic cell.

In certain example embodiments, the eukaryotic cell is a human cell or a non-human animal cell.

Described in certain example embodiments herein are vector systems comprising one or more vectors comprising one or more polynucleotides comprising one or more nucleic acid sequence that encode one or more components of the engineered nucleic acid systems of any one of the preceding paragraphs and as described in greater detail elsewhere herein, and optionally one or more regulatory elements operably coupled to one or more polynucleotides.

In certain example embodiments, the one or more of the one or more vectors are viral vectors.

In certain example embodiments, the viral vector(s) is/are a retroviral vector(s), lentiviral vector(s), adenoviral vector(s), adeno-associated viral vector(s), herpes simplex viral vector(s), or a combination thereof.

Described in certain example embodiments are delivery compositions comprising
a. an engineered nucleic acid targeting system of any one of the preceding paragraphs and as described in greater detail elsewhere herein;
b. one or more polynucleotides of any one of the preceding paragraphs and as described in greater detail elsewhere herein;
c. one or more vector systems of any one of the preceding paragraphs and as described in greater detail elsewhere herein; or
d. a combination thereof, and
a delivery vehicle, wherein a, b, c, d, or e, are associated with or operably coupled to the delivery vehicle.

Described in certain example embodiments are cells or progeny thereof comprising:
a. an engineered nucleic acid targeting system of any one of the preceding paragraphs and as described in greater detail elsewhere herein;
b. one or more polynucleotides of any one of the preceding paragraphs and as described in greater detail elsewhere herein;
c. one or more vector systems of any one of the preceding paragraphs and as described in greater detail elsewhere herein;
d. a delivery formulation of any one of the preceding paragraphs and as described in greater detail elsewhere herein;
e. one or more polynucleotide modifications produced by an engineered nucleic acid targeting system of any one of the preceding paragraphs and as described in greater detail elsewhere herein; or
f. a combination thereof.

In certain example embodiments, the cell or progeny thereof is a prokaryotic or eukaryotic cell.

Described in certain example embodiments herein are tissues, organs, or organisms comprising a cell or progeny thereof as in any one of the preceding paragraphs and as described in greater detail elsewhere herein or a population thereof.

Described in certain example embodiments herein are pharmaceutical formulations comprising
 a. an engineered nucleic acid targeting system of any one of the preceding paragraphs and as described in greater detail elsewhere herein;
 b. one or more polynucleotides of any one of the preceding paragraphs and as described in greater detail elsewhere herein;
 c. one or more vector systems of any one of the preceding paragraphs and as described in greater detail elsewhere herein;
 d. a delivery formulation of any one of the preceding paragraphs and as described in greater detail elsewhere herein;
 e. a cell or progeny thereof as in any one of the preceding paragraphs and as described in greater detail elsewhere herein;
 f. a tissue, an organ, or an organism as in any one of the preceding paragraphs and as described in greater detail elsewhere herein; or
 g. a combination thereof, and
 a pharmaceutically acceptable carrier.

Described in certain example embodiments herein are products produced by a cell or progeny thereof as in any one of the preceding paragraphs and as described in greater detail elsewhere herein or a population thereof, a tissue, organ, or organism as in any one of the preceding paragraph and as described in greater detail elsewhere herein, or both.

Described in certain example embodiments herein are methods of modifying one or more target polynucleotides, the method comprising contacting the one or more target polynucleotides with an engineered nucleic acid targeting system of any one of the preceding paragraphs and as described in greater detail elsewhere herein, wherein the engineered nucleic acid targeting system is directed to the one or more target sequences by the guide nucleic acid guide molecule(s) of the engineered nucleic acid targeting system, whereby one or more target polynucleotides is/are modified.

In certain example embodiments the modification is
 a. insertion of one or more polynucleotides;
 b. deletion of one or more polynucleotides;
 c. conversion of a C•G base pair to a T•A base pair;
 d. conversion of an A•T base pair to a G•C base pair; or
 e. a combination thereof.

In certain example embodiments, contacting occurs in vitro, in situ, ex vivo, or in vivo.

In certain example embodiments, contacting occurs within a cell.

Described in certain example embodiments herein are modified polynucleotides and/or modified cells or progeny thereof produced from a method as in of any one of the preceding paragraphs and as described in greater detail elsewhere herein.

In certain example embodiments, the cell is a eukaryotic cell or progeny thereof.

In certain example embodiments, the cell or progeny thereof is a human cell or progeny thereof or a non-human animal cell or progeny thereof.

In certain example embodiments, the cell or progeny thereof is a plant cell.

Described in certain example embodiments herein are methods of treating and/or preventing a disease, condition, or a symptom thereof in a subject in need thereof, the method comprising administering to the subject in need thereof
 a. an engineered nucleic acid targeting system of any one of the preceding paragraphs and as described in greater detail elsewhere herein;
 b. one or more polynucleotides of any one of the preceding paragraphs and as described in greater detail elsewhere herein;
 c. one or more vector systems of any one of the preceding paragraphs and as described in greater detail elsewhere herein;
 d. a delivery formulation as in any one of the preceding paragraphs and as described in greater detail elsewhere herein;
 e. a cell or progeny thereof as in any one of the preceding paragraphs and as described in greater detail elsewhere herein;
 f. a tissue, an organ, or an organism as in any one of the preceding paragraphs and as described in greater detail elsewhere herein;
 g. a pharmaceutical formulation as in any one of the preceding paragraphs and as described in greater detail elsewhere herein;
 h. a product as in any one of the preceding paragraphs and as described in greater detail elsewhere herein; or
 i. any combination thereof.

Described in certain example embodiments herein are methods of treating and/or preventing a disease, condition, or a symptom thereof in a subject or cell thereof, the method comprising modifying one or more target polynucleotides in or from the subject or cell thereof by contacting the one or more target polynucleotides with an engineered nucleic acid targeting system of the description herein, wherein the engineered nucleic acid targeting system is directed to the one or more target sequences in one or more target polynucleotides by the guide nucleic acid guide molecule(s) of the engineered nucleic acid targeting system, whereby one or more target polynucleotides is/are modified.

In certain example embodiments, contacting occurs in vitro, in situ, ex vivo, or in vivo.

In certain example embodiments, contacting occurs ex vivo in a cell obtained from the subject or progeny thereof and wherein the method further comprises administering cell or obtained from the subject or progeny to the subject after contacting the cell or progeny thereof with the engineered targeting system.

Described in certain example embodiments herein are methods of generating a modified organism, the method comprising modifying one or more target polynucleotides in a cell by a method as in any one of the preceding paragraphs and as described in greater detail elsewhere herein.

In certain example embodiments, the organism is a non-human animal.

In certain example embodiments, the organism is a plant.

Described in certain example embodiments herein are methods of identifying a trait of interest in an organism where the trait of interest is encoded by one or more target polynucleotides, the method comprising contacting the organism or sample therefrom comprising polynucleotides with an engineered nucleic acid targeting system of any one of the preceding paragraphs and as described in greater detail elsewhere herein, wherein the engineered nucleic acid targeting system is directed to the one or more target sequences by the guide nucleic acid guide molecule(s) of the engineered nucleic acid targeting system, whereby one or more target polynucleotides, and thereby the one or more traits, are identified.

In certain example embodiments, one or more target polynucleotides are modified by the engineered nucleic acid targeting system.

In certain example embodiments, the method is performed in vitro, in situ, ex vivo, or in vivo.

In certain example embodiments, the organism is a plant, non-human animal, or human.

Described in certain example embodiments are methods of identifying a polynucleotide modifier, the method comprising exposing one or more polynucleotides to one or more candidate agents; and detecting one or more modified polynucleotides by contacting the one or more polynucleotides exposed to one or more candidate agents with an engineered nucleic acid targeting system of any one of the preceding paragraphs and as described in greater detail elsewhere herein, wherein the engineered nucleic acid targeting system is directed to the one or more target sequences of one or more modified target polynucleotides present in the sample by the guide nucleic acid guide molecule(s) of the engineered nucleic acid targeting system, whereby one or more modified target polynucleotides present in the sample are identified.

Described in certain example embodiments herein are methods of detecting one or more target polynucleotide present in a sample comprising polynucleotides, the method comprising contacting, in vitro, one or more target polynucleotides present in the sample with an engineered nucleic acid targeting system of any one of the preceding paragraphs and as described in greater detail elsewhere herein, wherein the engineered nucleic acid targeting system is directed to the one or more target sequences of one or more target polynucleotides present in the sample by the guide nucleic acid guide molecule(s) of the engineered nucleic acid targeting system, whereby one or more target polynucleotides present in the sample are identified.

These and other aspects, objects, features, and advantages of the example embodiments will become apparent to those having ordinary skill in the art upon consideration of the following detailed description of example embodiments.

BRIEF DESCRIPTION OF THE DRAWINGS

An understanding of the features and advantages of the present invention will be obtained by reference to the following detailed description that sets forth illustrative embodiments, in which the principles of the invention may be utilized, and the accompanying drawings of which:

FIG. 1—shows a sequence view of exemplary Type II-D IntCas9s (light gray bar), direct repeats (DR) (black bar), and tracrRNA (med gray bar).

The figures herein are for illustrative purposes only and are not necessarily drawn to scale.

DETAILED DESCRIPTION OF THE EXAMPLE EMBODIMENTS

General Definitions

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, $2^{nd}$ edition (1989) (Sambrook, Fritsch, and Maniatis); Molecular Cloning: A Laboratory Manual, $4^{th}$ edition (2012) (Green and Sambrook); Current Protocols in Molecular Biology (1987) (F. M. Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboratory Manual (1988) (Harlow and Lane, eds.): Antibodies A Laboratory Manual, $2^{nd}$ edition 2013 (E. A. Greenfield ed.); Animal Cell Culture (1987) (R. I. Freshney, ed.); Benjamin Lewin, Genes IX, published by Jones and Bartlett, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology 2nd ed., J. Wiley & Sons (New York, N.Y. 1994), March, Advanced Organic Chemistry Reactions, Mechanisms and Structure 4th ed., John Wiley & Sons (New York, N.Y. 1992); and Marten H. Hofker and Jan van Deursen, Transgenic Mouse Methods and Protocols, $2^{nd}$ edition (2011).

As used herein, the singular forms "a", "an", and "the" include both singular and plural referents unless the context clearly dictates otherwise.

The term "optional" or "optionally" means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms "about" or "approximately" as used herein when referring to a measurable value such as a parameter, an amount, a temporal duration, and the like, are meant to encompass variations of and from the specified value, such as variations of +/−10% or less, +/−5% or less, +/−1% or less, and +/−0.1% or less of and from the specified value, insofar such variations are appropriate to perform in the disclosed invention. It is to be understood that the value to which the modifier "about" or "approximately" refers is itself also specifically, and preferably, disclosed.

As used herein, a "biological sample" may contain whole cells and/or live cells and/or cell debris. The biological sample may contain (or be derived from) a "bodily fluid". The present invention encompasses embodiments wherein the bodily fluid is selected from amniotic fluid, aqueous humour, vitreous humour, bile, blood serum, breast milk, cerebrospinal fluid, cerumen (earwax), chyle, chyme, endolymph, perilymph, exudates, feces, female ejaculate, gastric acid, gastric juice, lymph, mucus (including nasal drainage and phlegm), pericardial fluid, peritoneal fluid, pleural fluid, pus, rheum, saliva, sebum (skin oil), semen, sputum, synovial fluid, sweat, tears, urine, vaginal secretion, vomit and mixtures of one or more thereof. Biological samples include cell cultures, bodily fluids, cell cultures from bodily fluids. Bodily fluids may be obtained from a mammal organism, for example by puncture, or other collecting or sampling procedures.

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

Various embodiments are described hereinafter. It should be noted that the specific embodiments are not intended as an exhaustive description or as a limitation to the broader aspects discussed herein. One aspect described in conjunction with a particular embodiment is not necessarily limited to that embodiment and can be practiced with any other embodiment(s). Reference throughout this specification to "one embodiment", "an embodiment," "an example embodiment," means that a particular feature, structure or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment, but may. Furthermore, the particular features, structures or characteristics may be combined in any suitable manner, as would be apparent to a person skilled in the art from this disclosure, in one or more embodiments. Furthermore, while some embodiments described herein include some, but not other features included in other embodiments, combinations of features of different embodiments are meant to be within the scope of the invention. For example, in the appended claims, any of the claimed embodiments can be used in any combination.

As used herein with reference to the relationship between DNA, cDNA, cRNA, mRNA, protein/peptides, and the like "corresponding to" or "encoding" (used interchangeably herein) refers to the underlying biological relationship between these different molecules. As such, one of skill in the art would understand that operatively "corresponding to" can direct them to determine the possible underlying and/or resulting sequences of other molecules given the sequence of any other molecule which has a similar biological relationship with these molecules. For example, from a DNA sequence an RNA sequence can be determined and from an RNA sequence a cDNA sequence can be determined.

All publications, published patent documents, and patent applications cited herein are hereby incorporated by reference to the same extent as though each individual publication, published patent document, or patent application was specifically and individually indicated as being incorporated by reference.

Overview

Embodiments disclosed herein provide non-natural or engineered compositions and systems as well as their use in methods of modifying a target polynucleotide. In general, the systems include a small Cas Type II-D protein. The Cas protein may be recruited to a target sequence by a guide RNA and generate a break on the target sequence. In some embodiments, the guide RNA can further include a template with desired mutations or other sequence elements. In some exemplary embodiments, the Cas protein is a nickase that generates a single-strand break on nucleic acid molecule.

Other compositions, compounds, methods, features, and advantages of the present disclosure will be or become apparent to one having ordinary skill in the art upon examination of the following drawings, detailed description, and examples. It is intended that all such additional compositions, compounds, methods, features, and advantages be included within this description, and be within the scope of the present disclosure.

Small Type II-D Cas Proteins and Systems

Described herein are small Type II-D Cas proteins (or simply Type II-D Cas proteins) and systems thereof (e.g., CRISPR-Cas systems) that include one or more of the Type II-D Cas proteins or variant(s) thereof. Exemplary embodiments of small Type II-D Cas proteins and CRISPR-Cas systems that can include the small Type II-D Cas proteins are described in greater detail below. Thus, it will be appreciated that where a CRISPR-Cas system or component thereof is described below (such as a guide molecule, Cas protein, or other component) that such a system or component is referring to one that can include or associate with small Type II-D Cas protein described herein. Likewise, where the term Cas protein is used below, it will be appreciated that such a Cas protein can be a small Type II-D Cas protein or variant thereof.

In general, a Cas protein (used interchangeably herein with CRISPR protein, CRISPR enzyme, CRISPR-Cas protein, CRISPR-Cas enzyme, Cas, Cas effector, or CRISPR effector) and/or a crRNA (used interchangeably with a guide RNA, and RNA component) is a component of a CRISPR-Cas system. A CRISPR-Cas system or CRISPR system refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Type II-D Cas, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). CRISPR-Cas systems are described in further detail below.

In some embodiments, the CRISPR-Cas system incorporating a small Type II-D Cas protein has only one small Type II-D Cas protein. In some embodiments, the CRISPR-Cas system incorporating a small Type II-D Cas protein has two or more two small Type II-D Cas protein. Where the CRISPR-Cas system includes more than one small Type II-D Cas proteins it will be appreciated that such small Type II-D Cas proteins can be homogeneous (i.e., the same) or heterogenous (i.e., different from each other in at least one aspect (e.g., small Type II-D Cas protein, optional additional functional domain(s), linker (if present), etc.).

Generally, and without being bound by theory, in some embodiments a CRISPR-Cas system can include one, a pair, or more of small Type II-D Cas proteins.

Small Type II-D Cas Proteins

Described in example embodiments herein are small Type II-D Cas proteins that have at least one RuvC domain and at least one HNH domain. In some examples, the small Cas proteins may be small Type II Cas proteins. In some embodiments, the Type II Cas proteins are Type II-D Cas proteins. In particular examples, the Type II Cas proteins are Type II-D IntCas9 proteins. In some examples, the IntCas9 protein may be from or derived from Gammaproteobacteria bacterium AqS3, Deltaproteobacteria bacterium GWF2_42_12, JGI Metagenome: IMG 3300025323, Nitrospirae bacterium RBG_13_39_12, Nitrospiraceae bacterium isolate UBA9935, or orthologs thereof. In certain example embodiments, the small Cas proteins may be about 950 amino acids or less in size. In certain example embodiments, the small Cas proteins may be less than or equal to 780 amino acids in size. In some embodiments, the IntCas9 protein is less than or equal to 780 amino acids in size.

In some embodiments, the small Type II-D Cas proteins include or are composed entirely of one or more polypeptides that is/are encoded by one or more polynucleotides that each have a sequence that is 70-100 percent identical to one of SEQ ID NOs: 31, 37, 39, 40, 44, 49, 55, 57, 63, 64, 68, 70, 76, and 80-133 or portion thereof (including, but not limited to, those regions in e.g., SEQ ID NOs. 80-133 identified in Tables 14-15 as a protein of interest (POI)). In some embodiments, the small Type II-D Cas proteins include or are composed entirely of one or more polypeptides that is/are encoded by one or more polynucleotides that each have a sequence that is about 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 percent identical to any one of SEQ ID NOs: SEQ ID NOs: 31, 37, 39, 40, 44, 49, 55, 57, 63, 64, 68, 70, 76, and 80-133 or portion thereof (including, but not limited to, those regions in e.g., SEQ ID NOs. 80-133 identified in Tables 14-15 as a protein of interest (POI)). In some embodiments, the small Type II-D Cas proteins include or are composed entirely of one or more polypeptides that is/are encoded by one or more polynucleotides that each have a sequence that is about 90-100 percent identical to any one of SEQ ID NOs. SEQ ID NOs: 31, 37, 39, 40, 44, 49, 55, 57, 63, 64, 68, 70, 76, and 80-133 or portion thereof (including, but not limited to, those regions in e.g., SEQ ID NOs. 80-133 identified in Tables 14-15 as a protein of interest (POI)), such as 91, 92, 93, 94, 95, 96, 97, 98, or 99 to 100 percent identical to any one of SEQ ID NOs. SEQ ID NOs: 31, 37, 39, 40, 44, 49, 55, 57, 63, 64, 68, 70, 76, and 80-133 or portion thereof (including, but not limited to, those regions in e.g., SEQ ID NOs. 80-133 identified in Tables 14-15 as a protein of interest (POI)). In some embodiments, the small Type II-D Cas proteins include or are composed entirely of one or more polypeptides that is/are encoded by one or more polynucleotides that each have a sequence that is about 95-96, 95-97, 95-98, 95-99, 96-97, 96-98, 96-99, 97-98, 97-99, or 98-99 percent identical to any one of SEQ ID NOs. SEQ ID NOs: 31, 37, 39, 40, 44, 49, 55, 57, 63, 64, 68, 70, 76, and 80-133 or portion thereof (including, but not limited to, those regions in e.g., SEQ ID NOs. 80-133 identified in Tables 14-15 as a protein of interest (POI)). See also, Tables 13-15 and Appendices A and B of U.S. Provisional Application Ser. No. 62/962,672, which is incorporated by reference as if expressed in its entirety herein. In some embodiments, a small Type II-D CRISPR-Cas system polynucleotide is 70-100 identical to any one of SEQ ID NOs: 31, 37, 39, 40, 44, 49, 55, 57, 63, 64, 68, 70, 76, and 80-133 or portion thereof (including, but not limited to, those regions in e.g., SEQ ID NOs. 80-133 identified in Tables 14-15 as a protein of interest (POI)).

The "portion thereof" referred to above in reference to the encoding polynucleotides is about 5, 10, 15, 20, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 205, 210, 215, 220, 225, 230, 235, 240, 245, 250, 255, 260, 265, 270, 275, 280, 285, 290, 295, 300, 305, 310, 315, 320, 325, 330, 335, 340, 345, 350, 355, 360, 365, 370, 375, 380, 385, 390, 395, 400, 405, 410, 415, 420, 425, 430, 435, 440, 445, 450, 455, 460, 465, 470, 475, 480, 485, 490, 495, 500, 505, 510, 515, 520, 525, 530, 535, 540, 545, 550, 555, 560, 565, 570, 575, 580, 585, 590, 595, 600, 605, 610, 615, 620, 625, 630, 635, 640, 645, 650, 655, 660, 665, 670, 675, 680, 685, 690, 695, 700, 705, 710, 715, 720, 725, 730, 735, 740, 745, 750, 755, 760, 765, 770, 775, 780, 785, 790, 795, 800, 805, 810, 815, 820, 825, 830, 835, 840, 845, 850, 855, 860, 865, 870, 875, 880, 885, 890, 895, 900, 905, 910, 915, 920, 925, 930, 935, 940, 945, 950, 955, 960, 965, 970, 975, 980, 985, 990, 995, 1000, 1005, 1010, 1015, 1020, 1025, 1030, 1035, 1040, 1045, 1050, 1055, 1060, 1065, 1070, 1075, 1080, 1085, 1090, 1095, 1100, 1105, 1110, 1115, 1120, 1125, 1130, 1135, 1140, 1145, 1150, 1155, 1160, 1165, 1170, 1175, 1180, 1185, 1190, 1195, 1200, 1205, 1210, 1215, 1220, 1225, 1230, 1235, 1240, 1245, 1250, 1255, 1260, 1265, 1270, 1275, 1280, 1285, 1290, 1295, 1300, 1305, 1310, 1315, 1320, 1325, 1330, 1335, 1340, 1345, 1350, 1355, 1360, 1365, 1370, 1375, 1380, 1385, 1390, 1395, 1400, 1405, 1410, 1415, 1420, 1425, 1430, 1435, 1440, 1445, 1450, 1455, 1460, 1465, 1470, 1475, 1480, 1485, 1490, 1495, 1500, 1505, 1510, 1515, 1520, 1525, 1530, 1535, 1540, 1545, 1550, 1555, 1560, 1565, 1570, 1575, 1580, 1585, 1590, 1595, 1600, 1605, 1610, 1615, 1620, 1625, 1630, 1635, 1640, 1645, 1650, 1655, 1660, 1665, 1670, 1675, 1680, 1685, 1690, 1695, 1700, 1705, 1710, 1715, 1720, 1725, 1730, 1735, 1740, 1745, 1750, 1755, 1760, 1765, 1770, 1775, 1780, 1785, 1790, 1795, 1800, 1805, 1810, 1815, 1820, 1825, 1830, 1835, 1840, 1845, 1850, 1855, 1860, 1865, 1870, 1875, 1880, 1885, 1890, 1895, 1900, 1905, 1910, 1915, 1920, 1925, 1930, 1935, 1940, 1945, 1950, 1955, 1960, 1965, 1970, 1975, 1980, 1985, 1990, 1995, 2000, 2005, 2010, 2015, 2020, 2025, 2030, 2035, 2040, 2045, 2050, 2055, 2060, 2065, 2070, 2075, 2080, 2085, 2090, 2095, 2100, 2105, 2110, 2115, 2120, 2125, 2130, 2135, 2140, 2145, 2150, 2155, 2160, 2165, 2170, 2175, 2180, 2185, 2190, 2195, 2200, 2205, 2210, 2215, 2220, 2225, 2230, 2235, 2240, 2245, 2250, 2255, 2260, 2265, 2270, 2275, 2280, 2285, 2290, 2295, 2300, 2305, 2310, 2315, 2320, 2325, 2330, 2335, 2340, 2345, 2350, 2355, 2360, 2365, 2370, 2375, 2380, 2385, 2390, 2395, 2400, 2405, 2410, 2415, 2420, 2425, 2430, 2435, 2440, 2445, 2450, 2455, 2460, 2465, 2470, 2475, 2480, 2485, 2490, 2495, 2500, 2505, 2510, 2515, 2520, 2525, 2530, 2535, 2540, 2545, 2550, 2555, 2560, 2565, 2570, 2575, 2580, 2585, 2590, 2595, 2600, 2605, 2610, 2615, 2620, 2625, 2630, 2635, 2640, 2645, 2650, 2655, 2660, 2665, 2670, 2675, 2680, 2685, 2690, 2695, 2700, 2705, 2710, 2715, 2720, 2725, 2730, 2735, 2740, 2745, 2750, 2755, 2760, 2765, 2770, 2775, 2780, 2785, 2790, 2795, 2800, 2805, 2810, 2815, 2820, 2825, 2830, 2835, 2840, 2845, 2850, 2855, 2860, 2865, 2870, 2875, 2880, 2885, 2890, 2895, 2900, 2905, 2910, 2915, 2920, 2925, 2930, 2935, 2940, 2945, 2950, 2955, 2960, 2965, 2970, 2975, 2980, 2985, 2990, 2995, or 3000 consecutive nucleotides of any one of SEQ ID NOs. 31, 37, 39, 40, 44, 49, 55, 57, 63, 64, 68, 70, 76, and 80-133.

In some examples, the Type II-D Cas protein is a IntCas9. In some embodiments, IntCas9 is a crRNA-dependent endonuclease that contains two unrelated nuclease domains, RuvC and HNH, which are responsible for cleavage of the displaced (non-target) and target DNA strands, respectively, in the crRNA-target DNA complex. Type II-D Cas may be a polypeptide or fragment thereof having DNA binding activity, and/or DNA cleavage activity (e.g., endonuclease or nickase activity). "Type II-D Cas function" can be defined by any of a number of assays including, but not limited to, fluorescence polarization-based nucleic acid bind assays, fluorescence polarization-based strand invasion assays, transcription assays, EGFP disruption assays, DNA cleavage assays, and/or Surveyor assays, for example, as described herein. By "Type II-D nucleic acid molecule" is meant a polynucleotide encoding a Type II-D Cas polypeptide or fragment thereof. Type II-D Cas recognizes foreign DNA using Protospacer Adjacent Motif (PAM) sequence and the base pairing of the target DNA by the guide RNA (gRNA). The relative ease of inducing targeted strand breaks at any genomic loci by Type II-D Cas has enabled efficient genome editing in multiple cell types and organisms. Derivatives of Type II-D Cas disclosed herein can also be used as transcriptional activators/repressors.

In some embodiments, the Cas type II-D or other Cas protein is less than 1000 amino acids in size. For example, the Cas protein may be less than about 950, less than 900, less than 890, less than 880, less than 870, less than 860, less than 850, less than 840, less than 830, less than 820, less than 810, less than 800, less than 790, less than 780, less than 770, less than 760, less than 750, less than 700, less than 650, or less than 600 amino acids in size. In some examples, the Cas protein is less than 780 amino acids in size.

In some embodiments, the CRISPR-Cas system includes a Type II-D Cas protein that is less than 1000 amino acids in size. For example, the Type II-D Cas protein can be less than 950, less than 900, less than 890, less than 880, less than 870, less than 860, less than 850, less than 840, less than 830, less than 820, less than 810, less than 800, less than 790, less than 780, less than 770, less than 760, less than 750, less than 700, less than 650, or less than 600 amino acids in size. In some examples, the Type II-D Cas protein is less than about 950 amino acids or less than 900 amino acids in size. In some examples, the Cas protein is less than 850 amino acids in size. In some embodiments, the Type II-D Cas protein is a small Type II-D Cas protein that is less than about 950 amino acids, less than about 900 amino acids, less than about 850 amino acids in size. In some embodiments, the CRISPR-Cas system includes a Type II-D Cas that is less than 850 amino acids in size.

In some embodiments, the Type II-D Cas protein is about 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 701, 702, 703, 704, 705, 706, 707, 708, 709, 710, 711, 712, 713, 714, 715, 716, 717, 718, 719, 720, 721, 722, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 847, 848, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 903, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, or 950 amino acids in size or less.

In some embodiments, the CRISPR-Cas system includes one or more Type II-D Cas proteins that is/are at least 100, at least 200, at least 300, at least 400, at least 500, at least 600, at least 700, at least 800, or at least 900, amino acids but are less than 1000 amino acids in size.

In some embodiments, the small Cas proteins are a subgroup of Type II Cas proteins and are less than about 950 amino acids in size. In some embodiments, the small Cas proteins are a subgroup of Type II Cas proteins and are less than or equal to 780 amino acid in size.

CRISPR-Cas Systems

As previously described, the small type II-D Cas proteins can be included in a CRISPR-Cas system with or without additional Cas proteins described elsewhere herein. In general, a CRISPR-Cas or CRISPR system as used in herein and in documents, such as WO 2014/093622 (PCT/US2013/074667), refers collectively to genes, transcripts, proteins, and other elements involved in the expression of, directing the activity of CRISPR-associated ("Cas") genes or gene products, and/or the gene products themselves (e.g. Cas proteins), including, but not limited to, sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as a Type II-D Cas, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). See, e.g., Shmakov et al. (2015) "Discovery and Functional Characterization of Diverse Class 2 CRISPR-Cas Systems", Molecular Cell, DOI: dx.doi.org/10.1016/j.molcel.2015.10.008 and Makarova et al., 2020. Nature Rev Microbiol. 18:67-83. As previously described, such CRISPR-Cas systems described herein include one or more small Type II-D Cas proteins or variants thereof.

In some embodiments, CRISPR-Cas system includes one or more Cas proteins that have at least one RuvC domain and at least one HNH domain. The Cas protein may have a RuvC-like domain that contains an inserted HNH domain.

One or more components (e.g., a Type II-D Cas protein, a guide molecule or component thereof (e.g., a direct repeat), or other component) of a Type II-D CRISPR-Cas system described herein can be encoded by one or more polynucleotides according to any one of SEQ ID NOs: 31-133 or a portion thereof. One or more components (e.g., a Type II-D Cas protein, a guide molecule or component thereof (e.g., a direct repeat), or other component) of a Type II-D CRISPR-Cas system described herein can be encoded by one or more polynucleotides that is/are 70-100 percent identical to any one of SEQ ID NOs. 31-133 or portion thereof. One or more components (e.g., a Type II-D Cas protein, a guide molecule or component thereof (e.g., a direct repeat), or other component) of a Type II-D CRISPR-Cas system described herein can be encoded by one or more polynucleotides that is/are 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 percent identical to any one of SEQ ID NOs. 31-133 or a portion thereof. One or more components (e.g., a Type II-D Cas protein, a guide molecule or component thereof (e.g., a direct repeat), or other component) of a Type II-D CRISPR-Cas system described herein can be encoded by one or more polynucleotides that is/are 90-100 percent identical to any one of SEQ ID NOs. 31-133, such as 91, 92, 93, 94, 95, 96, 97, 98, or 99 to 100 percent identical to any one of SEQ ID NOs. 31-133, or a portion thereof. One or more components (e.g., a Type II-D Cas protein, a guide molecule or component thereof (e.g., a direct repeat), or other component) of a Type II-D CRISPR-Cas system described herein can be encoded by one or more polynucleotides that is/are about 95-96, 95-97, 95-98, 95-99, 96-97, 96-98, 96-99, 97-98, 97-99, or 98-99 percent identical to any one of SEQ ID NOs. 31-133.

In some embodiments, the portion thereof is a feature or sequence that is identified in any of Tables 13-15, such as a specific feature noted therein. As the phrase is used above, The "portion thereof" referred to above in reference to the encoding polynucleotides is about 5, 10, 15, 20, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 205, 210, 215, 220, 225, 230, 235, 240, 245, 250, 255, 260, 265, 270, 275, 280, 285, 290, 295, 300, 305, 310, 315, 320, 325, 330, 335, 340, 345, 350, 355, 360, 365, 370, 375, 380, 385, 390, 395, 400, 405, 410, 415, 420, 425, 430, 435, 440, 445, 450, 455, 460, 465, 470, 475, 480, 485, 490, 495, 500, 505, 510, 515, 520, 525, 530, 535, 540, 545, 550, 555, 560, 565, 570, 575, 580, 585, 590, 595, 600, 605, 610, 615, 620, 625, 630, 635, 640, 645, 650, 655, 660, 665, 670, 675, 680, 685, 690, 695, 700, 705, 710, 715, 720, 725, 730, 735, 740, 745, 750, 755, 760, 765, 770, 775, 780, 785, 790, 795, 800, 805, 810, 815, 820, 825, 830, 835, 840, 845, 850, 855, 860, 865, 870, 875, 880, 885, 890, 895, 900, 905, 910, 915, 920, 925, 930, 935, 940, 945, 950, 955, 960, 965, 970, 975, 980, 985, 990, 995, 1000, 1005, 1010, 1015, 1020, 1025, 1030, 1035, 1040, 1045, 1050, 1055, 1060, 1065, 1070, 1075, 1080, 1085, 1090, 1095, 1100, 1105, 1110, 1115, 1120, 1125, 1130, 1135, 1140, 1145, 1150, 1155, 1160, 1165, 1170, 1175, 1180, 1185, 1190, 1195, 1200, 1205, 1210, 1215, 1220, 1225, 1230, 1235, 1240, 1245, 1250, 1255, 1260, 1265, 1270, 1275, 1280, 1285, 1290, 1295, 1300, 1305, 1310, 1315, 1320, 1325, 1330, 1335, 1340, 1345, 1350, 1355, 1360, 1365, 1370, 1375, 1380, 1385, 1390, 1395, 1400, 1405, 1410, 1415, 1420, 1425, 1430, 1435, 1440, 1445, 1450, 1455, 1460, 1465, 1470, 1475, 1480, 1485, 1490, 1495, 1500, 1505, 1510, 1515, 1520, 1525, 1530, 1535, 1540, 1545, 1550, 1555, 1560, 1565, 1570, 1575, 1580, 1585, 1590, 1595, 1600, 1605, 1610, 1615, 1620, 1625, 1630, 1635, 1640, 1645, 1650, 1655, 1660, 1665, 1670, 1675, 1680, 1685, 1690, 1695, 1700, 1705, 1710, 1715, 1720, 1725, 1730, 1735, 1740, 1745, 1750, 1755, 1760, 1765, 1770, 1775, 1780, 1785, 1790, 1795, 1800, 1805, 1810, 1815, 1820, 1825, 1830, 1835, 1840, 1845, 1850, 1855, 1860, 1865, 1870, 1875, 1880, 1885, 1890, 1895, 1900, 1905, 1910, 1915, 1920, 1925, 1930, 1935, 1940, 1945, 1950, 1955, 1960, 1965, 1970, 1975, 1980, 1985, 1990, 1995, 2000, 2005, 2010, 2015, 2020, 2025, 2030, 2035, 2040, 2045, 2050, 2055, 2060, 2065, 2070, 2075, 2080, 2085, 2090, 2095, 2100, 2105, 2110, 2115, 2120, 2125, 2130, 2135, 2140, 2145, 2150, 2155, 2160, 2165, 2170, 2175, 2180, 2185, 2190, 2195, 2200, 2205, 2210, 2215, 2220, 2225, 2230, 2235, 2240, 2245, 2250, 2255, 2260, 2265, 2270, 2275, 2280, 2285, 2290, 2295, 2300, 2305, 2310, 2315, 2320, 2325, 2330, 2335, 2340, 2345, 2350, 2355, 2360, 2365, 2370, 2375, 2380, 2385, 2390, 2395, 2400, 2405, 2410, 2415, 2420, 2425, 2430, 2435, 2440, 2445, 2450, 2455, 2460, 2465, 2470, 2475, 2480, 2485, 2490, 2495, 2500, 2505, 2510, 2515, 2520, 2525, 2530, 2535, 2540, 2545, 2550, 2555, 2560, 2565, 2570, 2575, 2580, 2585, 2590, 2595, 2600, 2605, 2610, 2615, 2620, 2625, 2630, 2635, 2640, 2645, 2650, 2655, 2660, 2665, 2670, 2675, 2680, 2685, 2690, 2695, 2700, 2705, 2710, 2715, 2720, 2725, 2730, 2735, 2740, 2745, 2750, 2755, 2760, 2765, 2770, 2775, 2780, 2785, 2790, 2795, 2800, 2805, 2810, 2815, 2820, 2825, 2830, 2835, 2840, 2845, 2850, 2855, 2860, 2865, 2870, 2875, 2880, 2885, 2890, 2895, 2900, 2905, 2910, 2915, 2920, 2925, 2930, 2935, 2940, 2945, 2950, 2955, 2960, 2965, 2970, 2975, 2980, 2985, 2990, 2995, or 3000 consecutive nucleotides of any one of SEQ ID NOs. 31-133.

In some embodiments, the CRISPR-Cas system includes a Type II-D effector (e.g., a Type II-D Cas effector) protein from or originated from an organism from a genus comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Corynebacterium, Carnobacterium, Rhodobacter, Listeria, Paludibacter, Clostridium, Lachnospiraceae, Clostridiaridium, Leptotrichia, Francisella, Legionella, Alicyclobacillus, Methanomethyophilus, Porphyromonas, Prevotella, Bacteroidetes, Helcococcus, Leptospira, Desulfovibrio, Desulfonatronum, Opituaceae, Tuberibacillus, Bacillus, Brevibacillus, Methylobacterium* or *Acidaminococcus, Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma,* or *Campylobacter.*

In some embodiments of the CRISPR-Cas system that include a Type II-D effector, the Type II-D Cas effector protein is from or originated from an organism selected from *S. mutans, S. agalactiae, S. equisimilis, S. sanguinis, S. pneumonia, C. jejuni, C. coli; N. salsuginis, N. tergarcus; S. auricularis, S. carnosus; N. meningitides, N. gonorrhoeae, L. monocytogenes, L. ivanovii; C. botulinum, C. difficile, C. tetani,* or *C. sordellii, Francisella tularensis* 1, *Francisella tularensis* subsp. *novicida, Prevotella albensis, Lachnospiraceae bacterium* MC2017 1, *Butyrivibrio proteoclasticus, Peregrinibacteria bacterium* GW2011_GWA2_33_10, *Parcubacteria bacterium* GW2011_GWC2_44_17, *Smithella* sp. SCADC, *Acidaminococcus* sp. BV3L6, *Lachnospiraceae bacterium* MA2020, *Candidatus Methanoplasma termitum, Eubacterium eligens, Moraxella bovoculi* 237, *Leptospira inadai, Lachnospiraceae bacterium* ND2006, *Porphyromonas crevioricanis* 3, *Prevotella disiens,* and *Porphyromonas macacae.* In particular embodiments, the effector protein is a Type II-D Cas effector protein from an organism from or originated from *Streptococcus pyogenes, Staphylococcus aureus,* or *Streptococcus thermophilus* Type II-D Cas. In some embodiments, the Type II-D Cas is derived from a bacterial species selected from *Streptococcus pyogenes, Staphylococcus aureus,* or *Streptococcus thermophilus* Type II-D Cas. In certain embodiments, the Type II-D Cas is derived from a bacterial species selected from *Francisella tularensis* 1, *Prevotella albensis, Lachnospiraceae bacterium* MC2017 1, *Butyrivibrio proteoclasticus, Peregrinibacteria bacterium* GW2011 GWA2_33_10, *Parcubacteria bacterium* GW2011 GWC2_44_17, *Smithella* sp. SCADC, *Acidaminococcus* sp. BV3L6, *Lachnospiraceae bacterium* MA2020, *Candidatus Methanoplasma termitum, Eubacterium eligens, Moraxella bovoculi* 237, *Leptospira inadai, Lachnospiraceae bacterium* ND2006, *Porphyromonas crevioricanis* 3, *Prevotella disiens* and *Porphyromonas macacae.* In certain embodiments, the Type II-D Cas is derived from a bacterial species selected from *Acidaminococcus* sp. BV3L6, *Lachnospiraceae bacterium* MA2020. In certain embodiments, the effector protein is derived from a subspecies of *Francisella tularensis* 1, including but not limited to *Francisella tularensis* subsp. *Novicida*.

Specialized Cas-Based Systems

In some embodiments, the system that can include the small Type II-D Cas protein(s) is a Cas-based system that is capable of performing a specialized function or activity. For example, the Cas protein may be fused, operably coupled to, or otherwise associated with one or more functionals domains. In certain example embodiments, the Cas protein may be a catalytically dead Cas protein ("dCas") and/or have nickase activity. A nickase is a Cas protein that cuts only one strand of a double stranded target. In such embodiments, the dCas or nickase provide a sequence specific targeting functionality that delivers the functional domain to or proximate a target sequence. Example functional domains that may be fused to, operably coupled to, or otherwise associated with a Cas protein can be or include, but are not limited to a nuclear localization signal (NLS) domain, a nuclear export signal (NES) domain, a translational activation domain, a transcriptional activation domain (e.g. VP64, p65, MyoD1, HSF1, RTA, and SET7/9), a translation initiation domain, a transcriptional repression domain (e.g., a KRAB domain, NuE domain, NcoR domain, and a SID domain such as a SID4X domain), a nuclease domain (e.g., FokI), a histone modification domain (e.g., a histone acetyltransferase), a light inducible/controllable domain, a chemically inducible/controllable domain, a transposase domain, a homologous recombination machinery domain, a recombinase domain, an integrase domain, and combinations thereof. Methods for generating catalytically dead Cas9 or a nickase Cas9 (WO 2014/204725, Ran et al. Cell. 2013 Sep. 12; 154(6):1380-1389), Cas12 (Liu et al. Nature Communications, 8, 2095 (2017), and Cas13 (International Patent Publication Nos. WO 2019/005884 and WO2019/060746) are known in the art and incorporated herein by reference. Such methods can be adapted for modifying the small Type II-D Cas proteins described herein.

In some embodiments, the functional domains can have one or more of the following activities: methylase activity, demethylase activity, translation activation activity, translation initiation activity, translation repression activity, transcription activation activity, transcription repression activity, transcription release factor activity, histone modification activity, nuclease activity, single-strand RNA cleavage activity, double-strand RNA cleavage activity, single-strand DNA cleavage activity, double-strand DNA cleavage activity, molecular switch activity, chemical inducibility, light inducibility, and nucleic acid binding activity. In some embodiments, the one or more functional domains may comprise epitope tags or reporters. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporters include, but are not limited to, glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and auto-fluorescent proteins including blue fluorescent protein (BFP).

The one or more functional domain(s) may be positioned at, near, and/or proximity to a terminus of the effector protein (e.g., a Cas protein). In embodiments having two or more functional domains, each of the two can be positioned at or near or in proximity to a terminus of the effector protein (e.g., a Cas protein). In some embodiments, such as those where the functional domain is operably coupled to the effector protein, the one or more functional domains can be tethered or linked via a suitable linker (including, but not limited to, GlySer linkers) to the effector protein (e.g., a Cas protein). When there is more than one functional domain, the functional domains can be same or different. In some embodiments, all the functional domains are the same. In some embodiments, all of the functional domains are different from each other. In some embodiments, at least two of the functional domains are different from each other. In some embodiments, at least two of the functional domains are the same as each other.

Other suitable functional domains can be found, for example, in International Patent Publication No. WO 2019/018423.

Split CRISPR-Cas Systems

In some embodiments, the CRISPR-Cas system is a split CRISPR-Cas system. See e.g., Zetche et al., 2015. Nat. Biotechnol. 33(2): 139-142 and International Patent Publication WO 2019/018423, the compositions and techniques of which can be used in and/or adapted for use with the present invention. Split CRISPR-Cas proteins are set forth herein and in documents incorporated herein by reference in further detail herein. In certain embodiments, each part of a split CRISPR protein are attached to a member of a specific binding pair, and when bound with each other, the members of the specific binding pair maintain the parts of the CRISPR protein in proximity. In certain embodiments, each part of a split CRISPR protein is associated with an inducible binding pair. An inducible binding pair is one which is capable of being switched "on" or "off" by a protein or small molecule that binds to both members of the inducible binding pair. In some embodiments, CRISPR proteins may preferably split between domains, leaving domains intact. In particular embodiments, said Cas split domains (e.g., RuvC and HNH domains in the case of Type II-D Cas proteins) can be simultaneously or sequentially introduced into the cell such that said split Cas domain(s) process the target nucleic acid sequence in the algae cell. The reduced size of the split Cas compared to the wild type Cas allows other methods of delivery of the systems to the cells, such as the use of cell penetrating peptides as described herein.

DNA and RNA Base Editing

The present disclosure also provides for base editing systems. In some embodiments, the CRISPR-Cas system is capable of DNA and/or RNA base editing. Thus, in some embodiments the CRISPR-Cas system can be a base editing system. As used herein, "base editing" refers generally to the process of polynucleotide modification via a CRISPR-Cas-based or Cas-based system that does not include excising nucleotides to make the modification. Base editing can convert base pairs at precise locations without generating excess undesired editing byproducts that can be made using traditional CRISPR-Cas systems.

In general, a base-editing system may comprise a deaminase (e.g., an adenosine deaminase or cytidine deaminase) fused with a nucleic acid-guided nuclease, e.g., Cas protein. The Cas protein may be a dead Cas protein or a Cas nickase protein. In certain examples, the system comprises a mutated form of an adenosine deaminase fused with a dead CRISPR-Cas or CRISPR-Cas nickase. The mutated form of the adenosine deaminase may have both adenosine deaminase and cytidine deaminase activities.

The based editing systems may be capable of modifying a single nucleotide in a target polynucleotide. The modification may repair or correct a G→A or C→T point mutation, a T→C or A→G point mutation, or a pathogenic SNP. Accordingly, the compositions and systems may remedy a disease caused by a G→A or C→T point mutation, a T→C or A→G point mutation, or a pathogenic SNP.

In some embodiments, the present disclosure provides an engineered adenosine deaminase. The engineered adenosine deaminase may comprise one or more mutations herein. In some embodiments, the engineered adenosine deaminase has cytidine deaminase activity. In certain examples, the engineered adenosine deaminase has both cytidine deaminase activity and adenosine deaminase. In some cases, the modifications by base editors herein may be used for targeting post-translational signaling or catalysis. In some embodiments, compositions herein comprise nucleotide sequence comprising encoding sequences for one or more components of a base editing system. A base-editing system may comprise a deaminase (e.g., an adenosine deaminase or cytidine deaminase) fused, coupled to, or otherwise associated with a Cas protein or a variant thereof (such as a small Type II-D Cas protein or variant thereof described herein).

In some cases, the adenosine deaminase is double-stranded RNA-specific adenosine deaminase (ADAR). Examples of ADARs include those described Yiannis A Savva et al., The ADAR protein family, Genome Biol. 2012; 13(12): 252, which is incorporated by reference in its entirety. In some examples, the ADAR may be hADAR1. In certain examples, the ADAR may be hADAR2. The sequence of hADAR2 may be that described under Accession No. AF525422.1.

In some embodiments, the adenosine deaminase is a TadA protein such as *E. coli* TadA. See Kim et al., Biochemistry 45:6407-6416 (2006); Wolf et al., EMBO J. 21:3841-3851 (2002). In some embodiments, the adenosine deaminase is mouse ADA. See Grunebaum et al., Curr. Opin. Allergy Clin. Immunol. 13:630-638 (2013). In some embodiments, the adenosine deaminase is human ADAT2. See Fukui et al., J. Nucleic Acids 2010:260512 (2010). In some embodiments, the deaminase (e.g., adenosine or cytidine deaminase) is one or more of those described in Cox et al., Science. 2017, November 24; 358(6366): 1019-1027; Komore et al., Nature. 2016 May 19; 533(7603):420-4; and Gaudelli et al., Nature. 2017 Nov. 23; 551(7681):464-471.

In some cases, the deaminase may be a deaminase domain, e.g., a deaminase domain of ADAR ("ADAR-D"). In one example, the deaminase may be the deaminase domain of hADAR2 ("hADAR2-D), e.g., as described in Phelps K J et al., Recognition of duplex RNA by the deaminase domain of the RNA editing enzyme ADAR2. Nucleic Acids Res. 2015 January; 43(2):1123-32, which is incorporated by reference herein in its entirety. In a particular example, the hADAR2-D has a sequence comprising amino acid 299-701 of hADAR2, e.g., amino acid 299-701 of the sequence under Accession No. AF525422.1.

In certain examples, the system comprises a mutated form of an adenosine deaminase fused with a dead CRISPR-Cas or CRISPR-Cas nickase. The mutated form of the adenosine deaminase may have both adenosine deaminase and cytidine deaminase activities. In some embodiments, the adenosine deaminase may comprise one or more of the mutations: E488Q based on amino acid sequence positions of hADAR2, and mutations in a homologous ADAR protein corresponding to the above. In some embodiments, the adenosine deaminase may comprise one or more of the mutations: E488Q, V351G, based on amino acid sequence positions of hADAR2, and mutations in a homologous ADAR protein corresponding to the above. In some embodiments, the adenosine deaminase may comprise one or more of the mutations: E488Q, V351G, S486A, based on amino acid sequence positions of hADAR2, and mutations in a homologous ADAR protein corresponding to the above. In some embodiments, the adenosine deaminase may comprise one or more of the mutations: E488Q, V351G, S486A, T375S, based on amino acid sequence positions of hADAR2, and mutations in a homologous ADAR protein corresponding to the above. In some embodiments, the adenosine deaminase may comprise one or more of the mutations: E488Q, V351G, S486A, T375S, S370C, based on amino acid sequence positions of hADAR2, and mutations in a homologous ADAR protein corresponding to the above. In some embodiments, the adenosine deaminase may comprise one or more of the mutations: E488Q, V351G, S486A, T375S, S370C, P462A, based on amino acid sequence positions of hADAR2, and mutations in a homologous ADAR protein corresponding to the above. In some embodiments, the adenosine deaminase may comprise one or more of the mutations: E488Q, V351G, S486A, T375S, S370C, P462A, N597I, based on amino acid sequence positions of hADAR2, and mutations in a homologous ADAR protein corresponding to the above. In some embodiments, the adenosine deaminase may comprise one or more of the mutations: E488Q, V351G, S486A, T375S, S370C, P462A, N597I, L332I, based on amino acid sequence positions of hADAR2, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, based on amino acid sequence positions of hADAR2, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, based on amino acid sequence positions of hADAR2, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, based on amino acid sequence positions of hADAR2, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, based on amino acid sequence positions of hADAR2, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, V440I based on amino acid sequence positions of hADAR2, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, V440I, S495N based on amino acid sequence positions of hADAR2, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, V440I, S495N, K418E based on amino acid sequence positions of hADAR2, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, V440I, S495N, K418E, S661T based on amino acid sequence positions of hADAR2, and mutations in a homologous ADAR protein corresponding to the above. In some examples, provided herein includes a mutated adenosine deaminase e.g., an adenosine deaminase comprising one or more mutations of E488Q, V351G, S486A, T375S, S370C, P462A, N597I, L332I, I398V, K350I, M383L, D619G, S582T, V440I, S495N, K418E, S661T based on amino acid sequence positions of hADAR2, and mutations in a homologous ADAR protein corresponding to the above, fused with a dead CRISPR-Cas protein or CRISPR-Cas nickase. In some examples, provided herein includes a mutated adenosine deaminase e.g., an adenosine deaminase comprising E488Q, V351G, S486A, T375S, S370C, P462A, N597I, L332I, I398V, K350I, M383L, D619G, S582T, V440I, S495N, K418E, and S661T based on amino acid sequence positions of hADAR2, and mutations in a homologous ADAR protein corresponding to the above, fused with a dead CRISPR-Cas protein or a CRISPR-Cas nickase. In some examples, provided herein includes a mutated adenosine deaminase e.g., an adenosine deaminase comprising E488Q, V351G, S486A, T375S, S370C, P462A, N597I, L332I, I398V, K350I, M383L, D619G, S582T, V440I, S495N, K418E, S661T, and S375N based on amino acid sequence positions of hADAR2, and mutations in a homologous ADAR protein corresponding to the above, fused with a dead CRISPR-Cas protein or a CRISPR-Cas nickase. In some examples, provided herein includes a mutated adenosine deaminase e.g., an adenosine deaminase comprising E488Q, V351G, S486A, T375S, S370C, P462A, N597I, L332I, I398V, K350I, M383L, D619G, S582T, V440I, S495N, K418E, S661T, and S375A based on amino acid sequence positions of hADAR2, and mutations in a homologous ADAR protein corresponding to the above, fused with a dead CRISPR-Cas protein or a CRISPR-Cas nickase.

In some examples, provided herein includes a mutated adenosine deaminase e.g., an adenosine deaminase comprising E488Q and E620G based on amino acid sequence positions of hADAR2, and mutations in a homologous ADAR protein corresponding to the above, fused with a dead CRISPR-Cas protein or a CRISPR-Cas nickase.

In some examples, provided herein includes a mutated adenosine deaminase e.g., an adenosine deaminase comprising E488Q and Q696L based on amino acid sequence positions of hADAR2, and mutations in a homologous ADAR protein corresponding to the above, fused with a dead CRISPR-Cas protein or a CRISPR-Cas nickase.

In some embodiments, the adenosine deaminase may be a tRNA-specific adenosine deaminase or a variant thereof. In some embodiments, the adenosine deaminase may comprise one or more of the mutations: W23L, W23R, R26G, H36L, N37S, P48S, P48T, P48A, I49V, R51L, N72D, L84F, S97C, A106V, D108N, H123Y, G125A, A142N, S146C, D147Y, R152H, R152P, E155V, I156F, K157N, K161T, based on amino acid sequence positions of E. coli TadA, and mutations in a homologous deaminase protein corresponding to the above. In some embodiments, the adenosine deaminase may comprise one or more of the mutations: D108N based on amino acid sequence positions of E. coli TadA, and mutations in a homologous deaminase protein corresponding to the above. In some embodiments, the adenosine deaminase may comprise one or more of the mutations: A106V, D108N, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, based on amino acid sequence positions of E. coli TadA, and mutations in a homologous deaminase protein corresponding to the above. In some embodiments, the adenosine deaminase may comprise one or more of the mutations: A106V, D108N, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, L84F, H123Y, I156F, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, L84F, H123Y, I156F, A142N, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, A142N, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, W23R, P48A, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, W23R, P48A, A142N, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, W23R, P48A, R152P, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, W23R, P48A, R152P, A142N, based on amino acid sequence positions of E. coli TadA, and mutations in a homologous deaminase protein corresponding to the above.

In some examples, the base editing systems may comprise an intein-mediated trans-splicing system that enables in vivo delivery of a base editor, e.g., a split-intein cytidine base editor (CBE) or adenine base editor (ABE) engineered to trans-splice. Examples of such base editing systems include those described in Colin K. W. Lim et al., Treatment of a Mouse Model of ALS by In Vivo Base Editing, Mol Ther. 2020 Jan. 14. pii: S1525-0016(20)30011-3. doi: 10.1016/j.ymthe.2020.01.005; and Jonathan M. Levy et al., Cytosine and adenine base editing of the brain, liver, retina, heart and skeletal muscle of mice via adeno-associated viruses, Nature Biomedical Engineering volume 4, pages 97-110(2020), which are incorporated by reference herein in their entireties.

Certain mutations of APOBEC1 and APOBEC3 proteins have been described in Kim et al., Nature Biotechnology (2017) 35(4):371-377 (doi:10.1038/nbt.3803); and Harris et al. Mol. Cell (2002) 10:1247-1253, each of which is incorporated herein by reference in its entirety.

In some embodiments, the cytidine deaminase is an APOBEC1 deaminase comprising one or more mutations at amino acid positions corresponding to W90, R118, H121, H122, R126, or R132 in rat APOBEC1, or an APOBEC3G deaminase comprising one or more mutations at amino acid positions corresponding to W285, R313, D316, D317X, R320, or R326 in human APOBEC3G.

In some embodiments, the cytidine deaminase comprises a mutation at tryptophane$^{90}$ of the rat APOBEC1 amino acid sequence, or a corresponding position in a homologous APOBEC protein, such as tryptophane$^{285}$ of APOBEC3G. In some embodiments, the tryptophane residue at position 90 is replaced by an tyrosine or phenylalanine residue (W90Y or W90F).

In some embodiments, the cytidine deaminase comprises a mutation at Arginine . . . of the rat APOBEC1 amino acid sequence, or a corresponding position in a homologous APOBEC protein. In some embodiments, the arginine residue at position 118 is replaced by an alanine residue (R118A).

In some embodiments, the cytidine deaminase comprises a mutation at Histidine$^{121}$ of the rat APOBEC1 amino acid sequence, or a corresponding position in a homologous APOBEC protein. In some embodiments, the histidine residue at position 121 is replaced by an arginine residue (H121R).

In some embodiments, the cytidine deaminase comprises a mutation at Histidine$^{122}$ of the rat APOBEC1 amino acid sequence, or a corresponding position in a homologous APOBEC protein. In some embodiments, the histidine residue at position 122 is replaced by an arginine residue (H122R).

In some embodiments, the deaminase is a cytidine deaminase. The term "cytidine deaminase" or "cytidine deaminase protein" as used herein refers to a protein, a polypeptide, or one or more functional domain(s) of a protein or a polypeptide that is capable of catalyzing a hydrolytic deamination reaction that converts an cytosine (or an cytosine moiety of a molecule) to an uracil (or a uracil moiety of a molecule), as shown below. In some embodiments, the cytosine-containing molecule is an cytidine (C), and the uracil-containing molecule is an uridine (U). The cytosine-containing molecule can be deoxyribonucleic acid (DNA) or ribonucleic acid (RNA).

In some embodiments, the cytidine deaminase comprises a mutation at Arginine$^{126}$ of the rat APOBEC1 amino acid sequence, or a corresponding position in a homologous APOBEC protein, such as Arginine$^{320}$ of APOBEC3G. In some embodiments, the arginine residue at position 126 is replaced by an alanine residue (R126A) or by a glutamic acid (R126E).

In some embodiments, the cytidine deaminase comprises a mutation at arginine$^{132}$ of the APOBEC1 amino acid sequence, or a corresponding position in a homologous APOBEC protein. In some embodiments, the arginine residue at position 132 is replaced by a glutamic acid residue (R132E).

In some embodiments, to narrow the width of the editing window, the cytidine deaminase may comprise one or more of the mutations: W90Y, W90F, R126E and R132E, based on amino acid sequence positions of rat APOBEC1, and mutations in a homologous APOBEC protein corresponding to the above.

In some embodiments, to reduce editing efficiency, the cytidine deaminase may comprise one or more of the mutations: W90A, R118A, R132E, based on amino acid sequence positions of rat APOBEC1, and mutations in a homologous APOBEC protein corresponding to the above. In particular embodiments, it can be of interest to use a cytidine deaminase enzyme with reduced efficacy to reduce off-target effects.

In some embodiments, the cytidine deaminase is wild-type rat APOBEC1 (rAPOBEC1, or a catalytic domain thereof. In some embodiments, the cytidine deaminase comprises one or more mutations in the rAPOBEC1 sequence, such that the editing efficiency, and/or substrate editing preference of rAPOBEC1 is changed according to specific needs.

According to the present disclosure, cytidine deaminases that can be used in connection with the present disclosure include, but are not limited to, members of the enzyme family known as apolipoprotein B mRNA-editing complex (APOBEC) family deaminase, an activation-induced deaminase (AID), or a cytidine deaminase 1 (CDA1). In particular embodiments, the deaminase in an APOBEC1 deaminase, an APOBEC2 deaminase, an APOBEC3A deaminase, an APOBEC3B deaminase, an APOBEC3C deaminase, and APOBEC3D deaminase, an APOBEC3E deaminase, an APOBEC3F deaminase an APOBEC3G deaminase, an APOBEC3H deaminase, or an APOBEC4 deaminase.

In the methods and systems of the present invention, the cytidine deaminase is capable of targeting Cytosine in a DNA single strand. In certain example embodiments the cytodine deaminase may edit on a single strand present outside of the binding component e.g. bound Cas13. In other example embodiments, the cytodine deaminase may edit at a localized bubble, such as a localized bubble formed by a mismatch at the target edit site but the guide sequence. In certain example embodiments the cytodine deaminase may contain mutations that help focus the area of activity such as those disclosed in Kim et al., Nature Biotechnology (2017) 35(4):371-377 (doi:10.1038/nbt.3803.

In some embodiments, the cytidine deaminase is derived from one or more metazoa species, including but not limited to, mammals, birds, frogs, squids, fish, flies and worms. In some embodiments, the cytidine deaminase is a human, primate, cow, dog rat or mouse cytidine deaminase.

In some embodiments, the cytidine deaminase is a human APOBEC, including hAPOBEC1 or hAPOBEC3. In some embodiments, the cytidine deaminase is a human AID.

In some embodiments, the cytidine deaminase protein recognizes and converts one or more target cytosine residue(s) in a single-stranded bubble of a RNA duplex into uracil residues (s). In some embodiments, the cytidine deaminase protein recognizes a binding window on the single-stranded bubble of a RNA duplex. In some embodiments, the binding window contains at least one target cytosine residue(s). In some embodiments, the binding window is in the range of about 3 bp to about 100 bp. In some embodiments, the binding window is in the range of about 5 bp to about 50 bp. In some embodiments, the binding window is in the range of about 10 bp to about 30 bp. In some embodiments, the binding window is about 1 bp, 2 bp, 3 bp, 5 bp, 7 bp, 10 bp, 15 bp, 20 bp, 25 bp, 30 bp, 40 bp, 45 bp, 50 bp, 55 bp, 60 bp, 65 bp, 70 bp, 75 bp, 80 bp, 85 bp, 90 bp, 95 bp, or 100 bp.

In some embodiments, the cytidine deaminase protein comprises one or more deaminase domains. Not intended to be bound by theory, it is contemplated that the deaminase domain functions to recognize and convert one or more target cytosine (C) residue(s) contained in a single-stranded bubble of a RNA duplex into (an) uracil (U) residue (s). In some embodiments, the deaminase domain comprises an active center. In some embodiments, the active center comprises a zinc ion. In some embodiments, amino acid residues in or near the active center interact with one or more nucleotide(s) 5' to a target cytosine residue. In some embodiments, amino acid residues in or near the active center interact with one or more nucleotide(s) 3' to a target cytosine residue.

In some embodiments, the cytidine deaminase comprises human APOBEC1 full protein (hAPOBEC1) or the deaminase domain thereof (hAPOBEC1-D) or a C-terminally truncated version thereof (hAPOBEC-T). In some embodiments, the cytidine deaminase is an APOBEC family member that is homologous to hAPOBEC1, hAPOBEC-D or hAPOBEC-T. In some embodiments, the cytidine deaminase comprises human AID1 full protein (hAID) or the deaminase domain thereof (hAID-D) or a C-terminally truncated version thereof (hAID-T). In some embodiments, the cytidine deaminase is an AID family member that is homologous to hAID, hAID-D or hAID-T. In some embodiments, the hAID-T is a hAID which is C-terminally truncated by about 20 amino acids.

In some embodiments, the cytidine deaminase comprises the wild-type amino acid sequence of a cytosine deaminase. In some embodiments, the cytidine deaminase comprises one or more mutations in the cytosine deaminase sequence, such that the editing efficiency, and/or substrate editing preference of the cytosine deaminase is changed according to specific needs.

Certain mutations of APOBEC1 and APOBEC3 proteins have been described in Kim et al., Nature Biotechnology (2017) 35(4):371-377 (doi:10.1038/nbt.3803); and Harris et al. Mol. Cell (2002) 10:1247-1253, each of which is incorporated herein by reference in its entirety.

In some embodiments, the cytidine deaminase is an APOBEC1 deaminase comprising one or more mutations at amino acid positions corresponding to W90, R118, H121, H122, R126, or R132 in rat APOBEC1, or an APOBEC3G deaminase comprising one or more mutations at amino acid positions corresponding to W285, R313, D316, D317X, R320, or R326 in human APOBEC3G.

In some embodiments, the cytidine deaminase comprises a mutation at tryptophane$^{90}$ of the rat APOBEC1 amino acid sequence, or a corresponding position in a homologous APOBEC protein, such as tryptophane$^{285}$ of APOBEC3G. In some embodiments, the tryptophane residue at position 90 is replaced by an tyrosine or phenylalanine residue (W90Y or W90F).

In some embodiments, the cytidine deaminase comprises a mutation at Arginine$^{118}$ of the rat APOBEC1 amino acid sequence, or a corresponding position in a homologous APOBEC protein. In some embodiments, the arginine residue at position 118 is replaced by an alanine residue (R118A).

In some embodiments, the cytidine deaminase comprises a mutation at Histidine$^{121}$ of the rat APOBEC1 amino acid sequence, or a corresponding position in a homologous APOBEC protein. In some embodiments, the histidine residue at position 121 is replaced by an arginine residue (H121R).

In some embodiments, the cytidine deaminase comprises a mutation at Histidine$^{122}$ of the rat APOBEC1 amino acid sequence, or a corresponding position in a homologous APOBEC protein. In some embodiments, the histidine residue at position 122 is replaced by an arginine residue (H122R).

In some embodiments, the cytidine deaminase comprises a mutation at Arginine$^{126}$ of the rat APOBEC1 amino acid sequence, or a corresponding position in a homologous APOBEC protein, such as Arginine$^{320}$ of APOBEC3G. In some embodiments, the arginine residue at position 126 is replaced by an alanine residue (R126A) or by a glutamic acid (R126E).

In some embodiments, the cytidine deaminase comprises a mutation at arginine$^{132}$ of the APOBEC1 amino acid sequence, or a corresponding position in a homologous APOBEC protein. In some embodiments, the arginine residue at position 132 is replaced by a glutamic acid residue (R132E).

In some embodiments, to narrow the width of the editing window, the cytidine deaminase may comprise one or more of the mutations: W90Y, W90F, R126E and R132E, based on amino acid sequence positions of rat APOBEC1, and mutations in a homologous APOBEC protein corresponding to the above.

In some embodiments, to reduce editing efficiency, the cytidine deaminase may comprise one or more of the mutations: W90A, R118A, R132E, based on amino acid sequence positions of rat APOBEC1, and mutations in a homologous APOBEC protein corresponding to the above. In particular embodiments, it can be of interest to use a cytidine deaminase enzyme with reduced efficacy to reduce off-target effects.

In some embodiments, the cytidine deaminase is wild-type rat APOBEC1 (rAPOBEC1, or a catalytic domain thereof. In some embodiments, the cytidine deaminase comprises one or more mutations in the rAPOBEC1 sequence, such that the editing efficiency, and/or substrate editing preference of rAPOBEC1 is changed according to specific needs.

In some embodiments, the cytidine deaminase is wild-type human APOBEC3G (hAPOBEC3G) or a catalytic domain thereof. In some embodiments, the cytidine deaminase comprises one or more mutations in the hAPOBEC3G sequence, such that the editing efficiency, and/or substrate editing preference of hAPOBEC3G is changed according to specific needs.

In some embodiments, the cytidine deaminase is wild-type human APOBEC1 (hAPOBEC1) or a catalytic domain thereof. In some embodiments, the cytidine deaminase comprises one or more mutations in the hAPOBEC1 sequence, such that the editing efficiency, and/or substrate editing preference of hAPOBEC1 is changed according to specific needs.

In some embodiments, the cytidine deaminase is wild-type *Petromyzon marinus* CDA1 (pmCDA1) or a catalytic domain thereof. In some embodiments, the cytidine deaminase comprises one or more mutations in the pmCDA1 sequence, such that the editing efficiency, and/or substrate editing preference of pmCDA1 is changed according to specific needs. In some embodiments, the cytidine deaminase is wild-type human AID (hAID) or a catalytic domain thereof. In some embodiments, the cytidine deaminase comprises one or more mutations in the pmCDA1 sequence, such that the editing efficiency, and/or substrate editing preference of pmCDA1 is changed according to specific needs.

Reference polypeptide sequences for APOBEC1, rAPOBEC1, hAPOBEC3G, pmCDA1, hAID, can be found in e.g. International Application Publication WO 2019126774.

Additional embodiments of the cytidine deaminase are disclosed in WO WO2017/070632, titled "Nucleobase Editor and Uses Thereof," which is incorporated herein by reference in its entirety.

In some embodiments, mutations to the cytidine deaminase affect the editing window width. In some embodiments, the cytidine deaminase component of the CD-functionalized CRISPR system comprises one or more mutations that reduce the catalytic efficiency of the cytidine deaminase, such that the deaminase is prevented from deamination of multiple cytidines per DNA binding event. In some embodiments, tryptophan at residue 90 (W90) of APOBEC1 or a corresponding tryptophan residue in a homologous sequence is mutated. A catalytically inactive Type II-D Cas can be fused to or linked to an APOBEC1 mutant that comprises a W90Y or W90F mutation. In some embodiments, tryptophan at residue 285 (W285) of APOBEC3G, or a corresponding tryptophan residue in a homologous sequence (is mutated. In some embodiments, the catalytically inactive Type II-D is fused to or linked to an APOBEC3G mutant that comprises a W285Y or W285F mutation.

In some embodiments, the cytidine deaminase component of CD-functionalized CRISPR system comprises one or more mutations that reduce tolerance for non-optimal presentation of a cytidine to the deaminase active site. In some embodiments, the cytidine deaminase comprises one or more mutations that alter substrate binding activity of the deaminase active site. In some embodiments, the cytidine deaminase comprises one or more mutations that alter the conformation of DNA to be recognized and bound by the deaminase active site. In some embodiments, the cytidine deaminase comprises one or more mutations that alter the substrate accessibility to the deaminase active site. In some embodiments, arginine at residue 126 (R126) of APOBEC1 or a corresponding arginine residue in a homologous sequence is mutated. In some embodiments, the catalytically inactive Type II-D Cas is fused to or linked to an APOBEC1 that comprises a R126A or R126E mutation. In some embodiments, arginine at residue 132 (R132) of APOBEC1 or a corresponding arginine residue in a homologous sequence is mutated. In some embodiments, the catalytically inactive Type II-D Cas is fused to or linked to an APOBEC1 mutant that comprises a R132E mutation.

In some embodiments, the APOBEC1 domain of the CD-functionalized CRISPR system comprises one, two, or three mutations selected from W90Y, W90F, R126A, R126E, and R132E. In some embodiments, the APOBEC1 domain comprises double mutations of W90Y and R126E. In some embodiments, the APOBEC1 domain comprises double mutations of W90Y and R132E. In some embodiments, the APOBEC1 domain comprises double mutations of R126E and R132E. In some embodiments, the APOBEC1 domain comprises three mutations of W90Y, R126E and R132E.

In some embodiments, one or more mutations in the cytidine deaminase as disclosed herein reduce the editing window width to about 2 nucleotides. In some embodiments, one or more mutations in the cytidine deaminase as disclosed herein reduce the editing window width to about 1 nucleotide. In some embodiments, one or more mutations in the cytidine deaminase as disclosed herein reduce the editing window width while only minimally or modestly affecting the editing efficiency of the enzyme. In some embodiments, one or more mutations in the cytidine deaminase as disclosed herein reduce the editing window width without reducing the editing efficiency of the enzyme. In some embodiments, one or more mutations in the cytidine deaminase as disclosed herein enable discrimination of neighboring cytidine nucleotides, which would be otherwise edited with similar efficiency by the cytidine deaminase.

Examples of base editing systems include those described in International Patent Publication Nos. WO 2019/071048 (e.g., paragraphs [0933]-[0938]), WO 2019/084063 (e.g., paragraphs [0173]-[0186], [0323]-[0475], [0893]-[1094]), WO 2019/126716 (e.g., paragraphs [0290]-[0425], [1077]-[1084]), WO 2019/126709 (e.g., paragraphs [0294]-[0453]), WO 2019/126762 (e.g., paragraphs [0309]-[0438]), WO 2019/126774 (e.g., paragraphs [0511]-[0670]), WO 20170710632 (e.g. paragraphs [0604]-[0605] et seq.), Cox DBT, et al., RNA editing with CRISPR-Cas13, Science. 2017 Nov. 24; 358(6366):1019-1027; Abudayyeh 00, et al., A cytosine deaminase for programmable single-base RNA editing, Science 26 Jul. 2019: Vol. 365, Issue 6451, pp. 382-386; Gaudelli N M et al., Programmable base editing of A•T to G•C in genomic DNA without DNA cleavage, Nature volume 551, pages 464-471 (23 Nov. 2017); Komor A C, et al., Programmable editing of a target base in genomic DNA without double-stranded DNA cleavage. Nature. 2016 May 19; 533(7603):420-4; Jordan L. Doman et al., Evaluation and minimization of Cas9-independent off-target DNA editing by cytosine base editors, Nat Biotechnol (2020). doi.org/10.1038/s41587-020-0414-6; and Richter M F et al., Phage-assisted evolution of an adenine base editor with improved Cas domain compatibility and activity, Nat Biotechnol (2020). doi.org/10.1038/s41587-020-0453-z, which are incorporated by reference herein in their entireties.

Additional CRISPR-Cas systems suitable for DNA and/or RNA base editing have been described in e.g., any of which can be adapted according to the present disclosure herein, such as to include a small Type II-D Cas protein or variant described in greater detail elsewhere herein.

In certain example embodiments, the nucleotide deaminase may be a DNA base editor used in combination with a DNA binding Cas protein such as, but not limited to, Class 2 Type II and Type V systems. Two classes of DNA base editors are generally known: cytosine base editors (CBEs) and adenine base editors (ABEs). CBEs convert a C•G base pair into a T•A base pair (Komor et al. 2016. Nature. 533:420-424; Nishida et al. 2016. Science. 353; and Li et al. Nat. Biotech. 36:324-327) and ABEs convert an A•T base pair to a G•C base pair. Collectively, CBEs and ABEs can mediate all four possible transition mutations (C to T, A to G, T to C, and G to A). Rees and Liu. 2018. Nat. Rev. Genet. 19(12): 770-788, particularly at FIGS. 1b, 2a-2c, 3a-3f, and Table 1. In some embodiments, the base editing system includes a CBE and/or an ABE. In some embodiments, a polynucleotide of the present invention described elsewhere herein can be modified using a base editing system. Rees and Liu. 2018. Nat. Rev. Gent. 19(12):770-788. Base editors also generally do not need a DNA donor template and/or rely on homology-directed repair. Komor et al. 2016. Nature. 533: 420-424; Nishida et al. 2016. Science. 353; and Gaudeli et al. 2017. Nature. 551:464-471. Upon binding to a target locus in the DNA, base pairing between the guide RNA of the system and the target DNA strand leads to displacement of a small segment of ssDNA in an "R-loop". Nishimasu et al. Cell. 156:935-949. DNA bases within the ssDNA bubble are modified by the enzyme component, such as a deaminase. In some systems, the catalytically disabled Cas protein can be a variant or modified Cas can have nickase functionality and can generate a nick in the non-edited DNA strand to induce cells to repair the non-edited strand using the edited strand as a template. Komor et al. 2016. Nature. 533:420-424; Nishida et al. 2016. Science. 353; and Gaudeli et al. 2017. Nature. 551:464-471.

Other Example Type V base editing systems are described in International Patent Publication Nos. WO 2018/213708, WO 2018/213726, and International Patent Applications No. PCT/US2018/067207, PCT/US2018/067225, and PCT/US2018/067307, each of which is incorporated herein by reference and can be adapted for use with and in view of embodiments of the present disclosure.

In certain example embodiments, the base editing system may be an RNA base editing system. As with DNA base editors, a nucleotide deaminase capable of converting nucleotide bases may be fused to a Cas protein, such as a Type II-D Cas. In the context of an RNA base editing system, the Cas protein is a Type II-D Cas, derivative thereof, or variant thereof that is capable of binding RNA. Other example RNA binding Cas proteins include, but are not limited to, RNA-binding Cas9s such as *Francisella novicida* Cas9 ("FnCas9"), and Class 2 Type VI Cas systems. The nucleotide deaminase may be a cytidine deaminase or an adenosine deaminase, or an adenosine deaminase engineered to have cytidine deaminase activity. In certain example embodiments, the RNA base editor may be used to delete or introduce a post-translation modification site in the expressed mRNA. In contrast to DNA base editors, whose edits are permanent in the modified cell, RNA base editors can provide edits where finer, temporal control may be needed, for example in modulating a particular immune response. Example Type VI RNA-base editing systems are described in Cox et al. 2017. Science 358: 1019-1027, International Patent Publication Nos. WO 2019/005884, WO 2019/005886, and WO 2019/071048, and International Patent Application Nos. PCT/US20018/05179 and PCT/US2018/067207, which are incorporated herein by reference. An example FnCas9 system that may be adapted for RNA base editing utilizing a Type II-D Cas is described in International Patent Publication No. WO 2016/106236, which is incorporated herein by reference.

An example method for delivery of base-editing systems, including use of a split-intein approach to divide CBE and ABE into reconstitutable halves, is described in Levy et al. Nature Biomedical Engineering doi.org/10.1038/s41441-019-0505-5 (2019), which is incorporated herein by reference and can be adapted for use with and in view of embodiments of the present disclosure.

Additional base editing systems that can be adapted for use with and in view of embodiments of the present disclosure are any of those described in, for example, Rees et al., *Nat. Rev. Genet.* 19, 770-788. (2018); Lee et al., *Nat. Commun.* 9: 4804. 1-5 (2018); Ryu et al., *Nat. Biotechnol.* 36, 536-539 (2018) pubmed.ncbi.nlm.nih.gov/29702637/; Lee et al., *Sci. Rep.* 9, 1662 (2019); Thuronyi et al., *Nat. Biotechnol.* 37, 1070-1079 (2019); Anzalone et al., Nature, 576, 149-157 (2019); Richter et al., *Nat. Biotechnol.* 38: 883-891 (2020); Abudayyeh et al., *Science* 365, 6451, pp. 382-386; DOI: 10.1126/science.aax7063; WO 2019/005884; WO 2019/005886; WO 2019/060746; WO 2019/071048; WO 2019/084063; WO 2020/028555, which are all herein incorporated by reference as if expressed in their entireties.

In some embodiments, a polynucleotide of the present invention described elsewhere herein can be modified using a base editing system.

Prime Editors

In some embodiments, the CRISPR-Cas system is capable of prime editing and thus is a prime editing system. In some embodiments, the prime editing system includes a small Type II-D Cas protein or variant described in greater detail elsewhere herein. In some embodiments, the prime editing system is used in a method to modify a polynucleotide. See e.g., Anzalone et al. 2019. Nature. 576: 149-157. Like base editing systems, prime editing systems can be capable of targeted modification of a polynucleotide without generating double stranded breaks and does not require donor templates. Further prime editing systems can be capable of all 12 possible combination swaps. Prime editing can operate via a "search-and-replace" methodology and can mediate targeted insertions, deletions, all 12 possible base-to-base conversion and combinations thereof. Generally, a prime editing system, as exemplified by PE1, PE2, and PE3 (Id.), can include a reverse transcriptase fused or otherwise coupled or associated with an RNA-programmable nickase and a prime-editing extended guide RNA (pegRNA) to facility direct copying of genetic information from the extension on the pegRNA into the target polynucleotide. Embodiments that can be used with the present invention include these and variants thereof. Prime editing can have the advantage of lower off-target activity than traditional CRIPSR-Cas systems along with few byproducts and greater or similar efficiency as compared to traditional CRISPR-Cas systems.

In some embodiments, the prime editing guide molecule can specify both the target polynucleotide information (e.g., sequence) and contain a new polynucleotide cargo that replaces target polynucleotides. To initiate transfer from the guide molecule to the target polynucleotide, the PE system can nick the target polynucleotide at a target side to expose a 3'hydroxyl group, which can prime reverse transcription of an edit-encoding extension region of the guide molecule (e.g., a prime editing guide molecule or peg guide molecule) directly into the target site in the target polynucleotide. See e.g., Anzalone et al. 2019. Nature. 576: 149-157, particularly at FIGS. 1b, 1c, related discussion, and Supplementary discussion.

In some embodiments, a prime editing system can be composed of a Cas polypeptide having nickase activity, a reverse transcriptase, and a guide molecule. The Cas polypeptide can lack nuclease activity. The guide molecule can include a target binding sequence as well as a primer binding sequence and a template containing the edited polynucleotide sequence. The guide molecule, Cas polypeptide, and/or reverse transcriptase can be coupled together or otherwise associate with each other to form an effector complex and edit a target sequence. In some embodiments, the Cas polypeptide is a Class 2, Type V Cas polypeptide. In some embodiments, the Cas polypeptide is a Type II-D Cas polypeptide (e.g., is a Type II-D Cas nickase). In some embodiments, the Cas polypeptide is fused to the reverse transcriptase. In some embodiments, the Cas polypeptide is linked to the reverse transcriptase. In some embodiments the Cas polypeptide is a small Type II-D Cas protein or variant thereof.

In some embodiments, the prime editing system can be a PE1 system or variant thereof, a PE2 system or variant thereof, or a PE3 (e.g. PE3, PE3b) system. See e.g., Anzalone et al. 2019. Nature. 576: 149-157, particularly at pgs. 2-3, FIGS. 2a, 3a-3f, 4a-4b, Extended data FIGS. 3a-3b, 4.

The peg guide molecule can be about 10 to about 200 or more nucleotides in length, such as 10 to/or 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, or 200 or more nucleotides in length. Optimization of the peg guide molecule can be accomplished as described in Anzalone et al. 2019. Nature. 576: 149-157, particularly at pg. 3, FIG. 2a-2b, and Extended Data FIG. 5a-c.

Cas Variants

The Cas proteins herein include variants and mutated forms of Cas proteins (comparing to wildtype or naturally occurring Cas proteins, including, but not limited to, the small Type II-D Cas proteins described in greater detail elsewhere herein). In some embodiments, one or more Cas proteins in the CRISPR-Cas system described herein (including but not limited to the small Type II-D Cas protein(s)) is a Cas variant. In some examples, the present disclosure includes variants and mutated forms of the Cas proteins. It is to be understood that mutated Cas has an altered or modified catalytic activity if the catalytic activity is different than the catalytic activity of the corresponding wild type Cas protein (e.g., unmutated Cas protein). Catalytic activity can be determined by means known in the art. By means of example, and without limitation, catalytic activity can be determined in vitro or in vivo by determination of indel percentage (for instance after a given time, or at a given dose). In certain embodiments, the catalytic activity of the Cas protein (e.g., the small Type II-D Cas protein(s)) of the invention is altered or modified. The variants or mutated forms of Cas protein may be catalytically inactive, e.g., have no or reduced nuclease activity compared to a corresponding wildtype. In certain examples, the variants or mutated forms of Cas protein have nickase activity. In some embodiments, the catalytic activity of the Cas protein is increased.

In certain embodiments, catalytic activity is increased. In certain embodiments, catalytic activity is increased by at least 5%, preferably at least 10%, more preferably at least 20%, such as at least 30%, at least 40%, at least 50%, at least 60%, at least 70%, at least 80%, at least 90%, or at least 100%. In certain embodiments, catalytic activity is decreased. In certain embodiments, catalytic activity is decreased by at least 5%, preferably at least 10%, more preferably at least 20%, such as at least 30%, at least 40%, at least 50%, at least 60%, at least 70%, at least 80%, at least 90%, or (substantially) 100%. The one or more mutations herein may inactivate the catalytic activity, which may substantially all catalytic activity, below detectable levels, or no measurable catalytic activity.

In some embodiments, one or more characteristics of a Cas variant protein may be different from a corresponding wiled type Cas protein. Examples of such characteristics include catalytic activity, gRNA binding, specificity of the Cas protein (e.g., specificity of editing a defined target), stability of the Cas protein, off-target binding, target binding, protease activity, nickase activity, PFS recognition, or a combination thereof.

In some embodiments, the gRNA binding of the engineered Cas protein is increased as compared to a corresponding wildtype Cas protein. In some embodiments, the gRNA binding of the engineered Cas protein is decreased as compared to a corresponding wildtype Cas protein. In some embodiments, the specificity of the Cas protein is increased as compared to a corresponding wildtype Cas protein. In some embodiments, the specificity of the Cas protein is decreased as compared to a corresponding wildtype Cas protein. In some embodiments, the stability of the Cas protein is increased as compared to a corresponding wildtype Cas protein. In some embodiments, the stability of the Cas protein is decreased as compared to a corresponding wildtype Cas protein. In some embodiments, the engineered Cas protein further comprises one or more mutations which inactivate catalytic activity. In some embodiments, the off-target binding of the Cas protein is increased as compared to a corresponding wildtype Cas protein. In some embodiments, the off-target binding of the Cas protein is decreased as compared to a corresponding wildtype Cas protein. In some embodiments, the target binding of the Cas protein is increased as compared to a corresponding wildtype Cas protein. In some embodiments, the target binding of the Cas protein is decreased as compared to a corresponding wildtype Cas protein. In some embodiments, the engineered Cas protein has a higher protease activity or polynucleotide-binding capability compared with a corresponding wildtype Cas protein. In some embodiments, the PFS recognition is altered as compared to a corresponding wildtype Cas protein.

In certain embodiments, the gRNA (crRNA) binding of the Cas protein of the invention is altered or modified. It is to be understood that mutated Cas has an altered or modified gRNA binding if the gRNA binding is different than the gRNA binding of the corresponding wild type Cas (i.e., unmutated Cas). gRNA binding can be determined by means known in the art. By means of example, and without limitation, gRNA binding can be determined by calculating binding strength or affinity (such as based on equilibrium constants, Ka, Kd, etc.). In certain embodiments, gRNA binding is increased. In certain embodiments, gRNA binding is increased by at least 5%, preferably at least 10%, more preferably at least 20%, such as at least 30%, at least 40%, at least 50%, at least 60%, at least 70%, at least 80%, at least 90%, or at least 100%. In certain embodiments, gRNA binding is decreased. In certain embodiments, gRNA binding is decreased by at least 5%, preferably at least 10%, more preferably at least 20%, such as at least 30%, at least 40%, at least 50%, at least 60%, at least 70%, at least 80%, at least 90%, or (substantially) 100%.

In certain embodiments, the specificity of the Cas protein of the invention is altered or modified. It is to be understood that mutated Cas has an altered or modified specificity if the specificity is different than the specificity of the corresponding wild type Cas (i.e. unmutated Cas). Specificity can be determined by means known in the art. By means of example, and without limitation, specificity can be determined by comparison of on-target activity and off-target activity. In certain embodiments, specificity is increased. In certain embodiments, specificity is increased by at least 5%, preferably at least 10%, more preferably at least 20%, such as at least 30%, at least 40%, at least 50%, at least 60%, at least 70%, at least 80%, at least 90%, or at least 100%. In certain embodiments, specificity is decreased. In certain embodiments, specificity is decreased by at least 5%, preferably at least 10%, more preferably at least 20%, such as at least 30%, at least 40%, at least 50%, at least 60%, at least 70%, at least 80%, at least 90%, or (substantially) 100%.

In certain embodiments, the stability of the Cas protein of the invention is altered or modified. It is to be understood that mutated Cas has an altered or modified stability if the stability is different than the stability of the corresponding wild type Cas (i.e. unmutated Cas). Stability can be determined by means known in the art. By means of example, and without limitation, stability can be determined by determining the half-life of the Cas protein. In certain embodiments, stability is increased. In certain embodiments, stability is increased by at least 5%, preferably at least 10%, more preferably at least 20%, such as at least 30%, at least 40%, at least 50%, at least 60%, at least 70%, at least 80%, at least 90%, or at least 100%. In certain embodiments, stability is decreased. In certain embodiments, stability is decreased by at least 5%, preferably at least 10%, more preferably at least 20%, such as at least 30%, at least 40%, at least 50%, at least 60%, at least 70%, at least 80%, at least 90%, or (substantially) 100%.

In certain embodiments, the target binding of the Cas protein of the invention is altered or modified. It is to be understood that mutated Cas has an altered or modified target binding if the target binding is different than the target binding of the corresponding wild type Cas (i.e. unmutated Cas). target binding can be determined by means known in the art. By means of example, and without limitation, target binding can be determined by calculating binding strength or affinity (such as based on equilibrium constants, Ka, Kd, etc.). In certain embodiments, target bindings increased. In certain embodiments, target binding is increased by at least 5%, preferably at least 10%, more preferably at least 20%, such as at least 30%, at least 40%, at least 50%, at least 60%, at least 70%, at least 80%, at least 90%, or at least 100%. In certain embodiments, target binding is decreased. In certain embodiments, target binding is decreased by at least 5%, preferably at least 10%, more preferably at least 20%, such as at least 30%, at least 40%, at least 50%, at least 60%, at least 70%, at least 80%, at least 90%, or (substantially) 100%.

In certain embodiments, the off-target binding of the Cas protein of the invention is altered or modified. It is to be understood that mutated Cas has an altered or modified off-target binding if the off-target binding is different than the off-target binding of the corresponding wild type Cas (i.e., unmutated Cas). Off-target binding can be determined by means known in the art. By means of example, and without limitation, off-target binding can be determined by calculating binding strength or affinity (such as based on equilibrium constants, Ka, Kd, etc.). In certain embodiments, off-target bindings increased. In certain embodiments, off-target binding is increased by at least 5%, preferably at least 10%, more preferably at least 20%, such as at least 30%, at least 40%, at least 50%, at least 60%, at least 70%, at least 80%, at least 90%, or at least 100%. In certain embodiments, off-target binding is decreased. In certain embodiments, off-target binding is decreased by at least 5%, preferably at least 10%, more preferably at least 20%, such as at least 30%, at least 40%, at least 50%, at least 60%, at least 70%, at least 80%, at least 90%, or (substantially) 100%.

In certain embodiments, the PFS (or PAM) recognition or specificity of the Cas protein of the invention is altered or modified. It is to be understood that mutated Cas has an altered or modified PFS recognition or specificity if the PFS recognition or specificity is different than the PFS recognition or specificity of the corresponding wild type Cas (i.e., unmutated Cas). PFS recognition or specificity can be determined by means known in the art. By means of example, and without limitation, PFS recognition or specificity can be determined by PFS (PAM) screens. In certain embodiments, at least one different PFS is recognized by the Cas. In certain embodiments, at least one PFS is recognized by the mutated Cas which is not recognized by the corresponding wild type Cas. In certain embodiments, at least one PFS is recognized by the mutated Cas which is not recognized by the corresponding wild type Cas, in addition to the wild type PFS. In certain embodiments, at least one PFS is recognized by the mutated Cas which is not recognized by the corresponding wild type Cas, and the wild type PFS is not anymore recognized. In certain embodiments, the PFS recognized by the mutated Cas is longer than the PFS recognized by the wild type Cas, such as 1, 2, or 3 nucleotides longer. In certain embodiments, the PFS recognized by the mutated Cas is shorter than the PFS recognized by the wild type Cas, such as 1, 2, or 3 nucleotides shorter.

In some cases, the present disclosure provides for mutated Cas proteins comprising one or more modified of amino acids. The amino acids: (a) interact with a guide RNA that forms a complex with the mutated Cas protein; (b) are in an active site, an inter-domain linker domain, or a bridge helix domain of the mutated Cas protein; or (c) a combination thereof.

The term "corresponding amino acid" or "residue which corresponds to" refers to a particular amino acid or analogue thereof in a Cas homolog or ortholog that is identical or functionally equivalent to an amino acid in reference Cas protein. Accordingly, as used herein, referral to an "amino acid position corresponding to amino acid position [X]" of a specified Cas protein represents referral to a collection of equivalent positions in other recognized Cas and structural homologues and families.

Exemplary variant Cas proteins are described below, but others are also described elsewhere herein, such as those containing accessory molecules or other functional domains.

Structural (Sub)Domains

Also described herein are embodiments of a mutated Cas protein containing one or more mutations of amino acids, wherein the amino acids: interact with a guide RNA that forms a complex with the engineered Cas protein; or are in an active site, e.g., in RuvC and/or HNH domains.

The types of mutations can be conservative mutations or non-conservative mutations. In certain preferred embodiments, the amino acid which is mutated is mutated into alanine (A). In certain preferred embodiments, if the amino acid to be mutated is an aromatic amino acid, it is mutated into alanine or another aromatic amino acid (e.g., H, Y, W, or F). In certain preferred embodiments, if the amino acid to be mutated is a charged amino acid, it is mutated into alanine or another charged amino acid (e.g., H, K, R, D, or E). In certain preferred embodiments, if the amino acid to be mutated is a charged amino acid, it is mutated into alanine or another charged amino acid having the same charge. In certain preferred embodiments, if the amino acid to be mutated is a charged amino acid, it is mutated into alanine or another charged amino acid having the opposite charge.

The invention also provides for methods and compositions wherein one or more amino acid residues of the effector protein may be modified e.g., an engineered or non-naturally-occurring effector protein or Cas. In an embodiment, the modification may comprise mutation of one or more amino acid residues of the effector protein. The one or more mutations may be in one or more catalytically active domains of the effector protein, or a domain interacting with the crRNA (such as the guide sequence or direct repeat sequence). The effector protein may have reduced, or abolished nuclease activity or alternatively increased nuclease activity compared with an effector protein lacking said one or more mutations. The effector protein may not direct cleavage of the RNA strand at the target locus of interest. In a preferred embodiment, the one or more mutations may comprise two mutations.

The Cas protein herein may comprise one or more amino acids mutated. In some embodiments, the amino acid is mutated to A, P, or V, preferably A. In some embodiments, the amino acid is mutated to a hydrophobic amino acid. In some embodiments, the amino acid is mutated to an aromatic amino acid. In some embodiments, the amino acid is mutated to a charged amino acid. In some embodiments, the amino acid is mutated to a positively charged amino acid. In some embodiments, the amino acid is mutated to a negatively charged amino acid. In some embodiments, the amino acid is mutated to a polar amino acid. In some embodiments, the amino acid is mutated to an aliphatic amino acid.

Destabilized Cas and Fusion Proteins

In certain embodiments, the Cas protein according to the invention as described herein is associated with or fused to a destabilization domain (DD). In some embodiments, the DD is ER50. A corresponding stabilizing ligand for this DD is, in some embodiments, 4HT. As such, in some embodiments, one of the at least one DDs is ER50 and a stabilizing ligand therefor is 4HT or CMP8. In some embodiments, the DD is DHFR50. A corresponding stabilizing ligand for this DD is, in some embodiments, TMP. As such, in some embodiments, one of the at least one DDs is DHFR50 and a stabilizing ligand therefor is TMP. In some embodiments, the DD is ER50. A corresponding stabilizing ligand for this DD is, in some embodiments, CMP8. CMP8 may therefore be an alternative stabilizing ligand to 4HT in the ER50 system. While it may be possible that CMP8 and 4HT can/should be used in a competitive matter, some cell types may be more susceptible to one or the other of these two ligands, and from this disclosure and the knowledge in the art the skilled person can use CMP8 and/or 4HT.

In some embodiments, one or two DDs may be fused to the N-terminal end of the Cas with one or two DDs fused to the C-terminal of the Cas. In some embodiments, the at least two DDs are associated with the Cas and the DDs are the same DD, i.e., the DDs are homologous. Thus, both (or two or more) of the DDs could be ER50 DDs. This is preferred in some embodiments. Alternatively, both (or two or more) of the DDs could be DHFR50 DDs. This is also preferred in some embodiments. In some embodiments, the at least two DDs are associated with the Cas and the DDs are different DDs, i.e., the DDs are heterologous. Thus, one of the DDS could be ER50 while one or more of the DDs or any other DDs could be DHFR50. Having two or more DDs which are heterologous may be advantageous as it would provide a greater level of degradation control. A tandem fusion of more than one DD at the N or C-term may enhance degradation; and such a tandem fusion can be, for example ER50-ER50-Cas or DHFR-DHFR-Cas It is envisaged that high levels of degradation would occur in the absence of either stabilizing ligand, intermediate levels of degradation would occur in the absence of one stabilizing ligand and the presence of the other (or another) stabilizing ligand, while low levels of degradation would occur in the presence of both (or two of more) of the stabilizing ligands. Control may also be imparted by having an N-terminal ER50 DD and a C-terminal DHFR50 DD.

In some embodiments, the fusion of the Cas with the DD comprises a linker between the DD and the Cas. In some embodiments, the linker is a GlySer linker. In some embodiments, the DD-Cas further comprises at least one Nuclear Export Signal (NES). In some embodiments, the DD-Cas comprises two or more NESs. In some embodiments, the DD-Cas comprises at least one Nuclear Localization Signal (NLS). This may be in addition to an NES. In some embodiments, the Cas comprises or consists essentially of or consists of a localization (nuclear import or export) signal as, or as part of, the linker between the Cas and the DD. HA or Flag tags are also within the ambit of the invention as linkers. Applicants use NLS and/or NES as linker and also use Glycine Serine linkers as short as GS up to $(GGGGS)_3$ (SEQ ID NO: 1).

Destabilizing domains have general utility to confer instability to a wide range of proteins; see, e.g., Miyazaki, J Am Chem Soc. Mar. 7, 2012; 134(9): 3942-3945, incorporated herein by reference. CMP8 or 4-hydroxytamoxifen can be destabilizing domains. More generally, A temperature-sensitive mutant of mammalian DHFR (DHFRts), a destabilizing residue by the N-end rule, was found to be stable at a permissive temperature but unstable at 37° C. The addition of methotrexate, a high-affinity ligand for mammalian DHFR, to cells expressing DHFRts inhibited degradation of the protein partially. This was an important demonstration that a small molecule ligand can stabilize a protein otherwise targeted for degradation in cells. A rapamycin derivative was used to stabilize an unstable mutant of the FRB domain of mTOR (FRB*) and restore the function of the fused kinase, GSK-3β.6,7 This system demonstrated that ligand-dependent stability represented an attractive strategy to regulate the function of a specific protein in a complex biological environment. A system to control protein activity can involve the DD becoming functional when the ubiquitin complementation occurs by rapamycin induced dimerization of FK506-binding protein and FKBP12. Mutants of human FKBP12 or ecDHFR protein can be engineered to be metabolically unstable in the absence of their high-affinity ligands, Shield-1 or trimethoprim (TMP), respectively. These mutants are some of the possible destabilizing domains (DDs) useful in the practice of the invention and instability of a DD as a fusion with a Cas confers to the Cas degradation of the entire fusion protein by the proteasome. Shield-1 and TMP bind to and stabilize the DD in a dose-dependent manner. The estrogen receptor ligand binding domain (ERLBD, residues 305-549 of ERS1) can also be engineered as a destabilizing domain. Since the estrogen receptor signaling pathway is involved in a variety of diseases such as breast cancer, the pathway has been widely studied and numerous agonist and antagonists of estrogen receptor have been developed. Thus, compatible pairs of ERLBD and drugs are known. There are ligands that bind to mutant but not wild-type forms of the ERLBD. By using one of these mutant domains encoding three mutations (L384M, M421G, G521R)12, it is possible to regulate the stability of an ERLBD-derived DD using a ligand that does not perturb endogenous estrogen-sensitive networks. An additional mutation (Y537S) can be introduced to further destabilize the ERLBD and to configure it as a potential DD candidate. This tetra-mutant is an advantageous DD development. The mutant ERLBD can be fused to a Cas and its stability can be regulated or perturbed using a ligand, whereby the Cas has a DD. Another DD can be a 12-kDa (107-amino-acid) tag based on a mutated FKBP protein, stabilized by Shield1 ligand; see, e.g., Nature Methods 5, (2008). For instance, a DD can be a modified FK506 binding protein 12 (FKBP12) that binds to and is reversibly stabilized by a synthetic, biologically inert small molecule, Shield-1; see, e.g., Banaszynski L A, Chen L C, Maynard-Smith L A, Ooi A G, Wandless T J. A rapid, reversible, and tunable method to regulate protein function in living cells using synthetic small molecules. Cell. 2006; 126:995-1004; Banaszynski L A, Sellmyer M A, Contag C H, Wandless T J, Thorne S H. Chemical control of protein stability and function in living mice. Nat Med. 2008; 14:1123-1127; Maynard-Smith L A, Chen L C, Banaszynski L A, Ooi A G, Wandless T J. A directed approach for engineering conditional protein stability using biologically silent small molecules. The Journal of biological chemistry. 2007; 282:24866-24872; and Rodriguez, Chem Biol. Mar. 23, 2012; 19(3): 391-398-all of which are incorporated herein by reference and may be employed in the practice of the invention in selected a DD to associate with a Cas in the practice of this invention. As can be seen, the knowledge in the art includes a number of DDs, and the DD can be associated with, e.g., fused to, advantageously with a linker, to a Cas, whereby the DD can be stabilized in the presence of a ligand and when there is the absence thereof the DD can become destabilized, whereby the Cas is entirely destabilized, or the DD can be stabilized in the absence of a ligand and when the ligand is present the DD can become destabilized; the DD allows the Cas and hence the CRISPR-Cas complex or system to be regulated or controlled-turned on or off so to speak, to thereby provide means for regulation or control of the system, e.g., in an in vivo or in vitro environment. For instance, when a protein of interest is expressed as a fusion with the DD tag, it is destabilized and rapidly degraded in the cell, e.g., by proteasomes. Thus, absence of stabilizing ligand leads to a D associated Cas being degraded. When a new DD is fused to a protein of interest, its instability is conferred to the protein of interest, resulting in the rapid degradation of the entire fusion protein. Peak activity for Cas is sometimes beneficial to reduce off-target effects. Thus, short bursts of high activity are preferred. The present invention in some embodiments is able to provide such peaks. In some senses the system is inducible. In some other senses, the system repressed in the absence of stabilizing ligand and de-repressed in the presence of stabilizing ligand.

Deactivated Inactivated Dead Cas Proteins

In certain embodiments, the Cas protein herein is a catalytically inactive or dead Cas protein. In some cases, Cas protein herein is a catalytically inactive or dead Cas protein (dCas). In some cases, a dead Cas protein, e.g., a dead Cas protein has nickase activity. In some embodiments, the dCas protein comprises mutations in the nuclease domain. In some embodiments, the dCas protein has been truncated. In some cases, the dead Cas protein is a dead small Type II-D Cas protein or variant thereof.

Where the Type II-D Cas protein has nuclease activity, the Type II-D Cas protein may be modified to have diminished nuclease activity e.g., nuclease inactivation of at least 70%, at least 80%, at least 90%, at least 95%, at least 97%, or 100% as compared with the wild type enzyme; or to put in another way, a Cas protein having advantageously about 0% of the nuclease activity of the non-mutated or wild type Cas protein, or no more than about 3% or about 5% or about 10% of the nuclease activity of the non-mutated or wild type Type II-D Cas enzyme. This is possible by introducing mutations into the nuclease domains of the Type II-D Cas and orthologs thereof.

In certain embodiments, the CRISPR enzyme is engineered and can comprise one or more mutations that reduce or eliminate a nuclease activity. When the enzyme is not SpCas9, mutations may be made at any or all residues corresponding to positions 10, 762, 840, 854, 863 and/or 986 of SpCas9 (which may be ascertained for instance by standard sequence comparison tools). Homology modelling: Corresponding residues in other Cas orthologs can be identified by the methods of Zhang et al., 2012 (Nature; 490 (7421): 556-60) and Chen et al., 2015 (PLoS Comput Biol; 11(5): e1004248)—a computational protein-protein interaction (PPI) method to predict interactions mediated by domain-motif interfaces. PrePPI (Predicting PPI), a structure based PPI prediction method, combines structural evidence with non-structural evidence using a Bayesian statistical framework. The method involves taking a pair of query proteins and using structural alignment to identify structural representatives that correspond to either their experimentally determined structures or homology models. Structural alignment is further used to identify both close and remote structural neighbors by considering global and local geometric relationships. Whenever two neighbors of the structural representatives form a complex reported in the Protein Data Bank, this defines a template for modelling the interaction between the two query proteins. Models of a complex are created by superimposing the representative structures on their corresponding structural neighbor in the template. This approach is in Dey et al., 2013 (Prot Sci; 22: 359-66).

In particular, any or all of the following mutations are preferred in SpCas9: D10, E762, H840, N854, N863, or D986; conservative substitution for any of the replacement amino acids is also envisaged. The point mutations that can substantially reduce nuclease activity include, but are not limited to, D10A, E762A, H840A, N854A, N863A and/or D986A. In some embodiments, the Type II-D Cas comprises two or more mutations, where the mutations are homologues of or the equivalent of D10, E762, H840, N854, N863, or D986 with reference to the SpCas9 protein. In some embodiments, the Type II-D Cas includes mutation that is the homolog or equivalent of an N580 mutation with reference to the SaCas9 protein. In some embodiments the Type II-D Cas includes a mutation that is the homologue or equivalent of an H840 mutation with respect to a Cas9 protein. In some embodiments, the Type II-D Cas comprises two or more mutations comprising D10A, E762A, H840A, N854A, N863A or D986A mutation(s) with reference to a SpCas9 protein or any corresponding ortholog, or N580A according to SaCas9 protein, or at least one mutation comprising H840A, or, optionally wherein the Type II-D Cas comprises: N580A according to SaCas9 protein or any corresponding ortholog; or D10A according to SpCas9 protein, or any corresponding ortholog, and N580A according to SaCas9 protein. In some embodiments, the Type II-D Cas comprises a H840A, or D10A and H840A, or D10A and N863A mutation(s), according to and with reference to a SpCas9 protein or any corresponding ortholog.

Mutations can also be made at neighboring residues, e.g., at amino acids near those indicated above that participate in the nuclease activity. In some embodiments, only the RuvC domain is inactivated, and in other embodiments, another putative nuclease domain is inactivated, wherein the effector protein complex functions as a nickase and cleaves only one DNA strand. In a preferred embodiment, the other putative nuclease domain is a HincII-like endonuclease domain. In some embodiments, two Type II-D Cas variants (each a different nickase) are used to increase specificity, two nickase variants are used to cleave DNA at a target (where both nickases cleave a DNA strand, while minimizing or eliminating off-target modifications where only one DNA strand is cleaved and subsequently repaired). In some embodiments, the Type II-D Cas effector protein cleaves sequences associated with or at a target locus of interest as a homodimer comprising two Type II-D Cas effector protein molecules. In some embodiments, the homodimer may comprise two Type II-D Cas effector protein molecules comprising a different mutation or mutation(s) in their respective RuvC domains.

The inactivated Type II-D Cas may have associated (e.g., via fusion protein) one or more functional domains, including for example, one or more domains from the group comprising, consisting essentially of, or consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g., light inducible). Preferred domains are Fok1, VP64, P65, HSF1, MyoD1. In the event that Fok1 is provided, it is advantageous that multiple Fok1 functional domains are provided to allow for a functional dimer and that gRNAs are designed to provide proper spacing for functional use (Fok1) as specifically described in Tsai et al. Nature Biotechnology, Vol. 32, Number 6, June 2014). The adaptor protein may utilize known linkers to attach such functional domains. In some cases, it is advantageous that additionally at least one NLS is provided. In some instances, it is advantageous to position the NLS at the N terminus. When more than one functional domain is included, the functional domains may be the same or different.

In general, the positioning of the one or more functional domain on the inactivated Type II-D Cas is one which allows for correct spatial orientation for the functional domain to affect the target with the attributed functional effect. For example, if the functional domain is a transcription activator (e.g., VP64 or p65), the transcription activator is placed in a spatial orientation which allows it to affect the transcription of the target. Likewise, a transcription repressor will be advantageously positioned to affect the transcription of the target, and a nuclease (e.g., Fok1) will be advantageously positioned to cleave or partially cleave the target. This may include positions other than the N-/C-terminus of the CRISPR enzyme.

The dead or deactivated Cas proteins may be used as target-binding proteins, (e.g., DNA binding proteins). In these cases, the dead or deactivated Cas proteins may be fused with one or more functional domains.

As described herein, corresponding catalytic domains of a Type II-D Cas effector protein may also be mutated to produce a mutated Type II-D Cas effector protein lacking all DNA cleavage activity or having substantially reduced DNA cleavage activity. In some embodiments, a nucleic acid-targeting effector protein may be considered to substantially lack all RNA cleavage activity when the RNA cleavage activity of the mutated enzyme is about no more than 25%, 10%, 5%, 1%, 0.1%, 0.01%, or less of the nucleic acid cleavage activity of the non-mutated form of the enzyme; an example can be when the nucleic acid cleavage activity of the mutated form is nil or negligible as compared with the non-mutated form. An effector protein may be identified with reference to the general class of enzymes that share homology to the biggest nuclease with multiple nuclease domains from the Type II CRISPR system. In some embodiments, the effector protein is a Type II-D Cas. In further embodiments, the effector protein is a Type II protein. By "derived" as used in this context, it is meant that the derived enzyme is largely based, in the sense of having a high degree of sequence homology with, a wildtype enzyme, but that it has been mutated (modified) in some way as known in the art or as described herein.

Other Cas Variants

In some embodiments, the Cas protein of the CRISPR-Cas complex is a Type II-D Cas protein comprising C80S and C574S mutations (with reference to SpCas9) and one or more mutations selected from the group consisting of S355C, E532C, E945C, E1068C, E1207C, 51116C, 51154C, S204C, D435C, E471C, K558C, Q674C, Q826C, S867C, and E1026C (with reference to SpCas9). The mutations can be introduced to the nucleotide sequence of (with reference to SpCas9) protein by conventional molecular biology techniques including, but not limited to, site-directed mutagenesis, CRISPR-Cas system, TALEN, ZFN, or meganucleases.

In some embodiments, the Cas protein of the CRISPR-Cas complex or system comprises a sortase recognition sequence Leu-Pro-Xxx-Thr-Gly (SEQ ID NO: 2). For example, a Type II-D Cas can be engineered to accommodate a single or multiple sortase recognition sequences (Leu-Pro-Xxx-Thr-Gly (SEQ ID NO: 2), where Xxx is any amino acid) at which position effector moieties can be linked. Sortase is a transpeptidase that cleaves its recognition sequence between Thr-Gly, and ligates an acceptor peptide containing an N-terminal glycine to the newly formed Thr carboxylate. Engineering sortase recognition sequences onto Type II-D Cas or other Cas proteins allows site-specific conjugation of any chemical payload. Insertion sites can be regions previously validated as cut sites for split Type II-D Cas, particularly those for which the N and C fragments have been shown to have a high affinity for each other.

One way to validate insertion sites in Type II-D Cas or other nucleic acid-targeting moiety as to tolerance to modification is by sortase-mediated ligation of the model substrate Gly-Gly-Gly-Lys(Biotin) (SEQ ID NO: 3). The biotin handle allows efficient detection of Type II-D Cas modification by immunoblotting and facilitates enrichment of labeled protein through affinity purification with anti-biotin or streptavidin. Cas9 activity has been validated using an EGFP based screening assay, wherein a U2OS.EGFP cell line is exposed to Cas9 containing a guide RNA sequence targeting EGFP, leading to loss of EGFP fluorescence. Active biotin-ligated Cas9 proteins can be validated for in vivo efficacy. Using the positively charged transfection agent, such as RNAiMAX, biotin-ligated Cas9-sgRNA ribonucleoproteins can be transfected into U20S.EGFP cell lines, comparing the loss of GFP fluorescence to the introduction of wtCas9. A similar approach can be used to evaluate Type II-D Cas activity.

Sortase-mediated ligation allows attachment to the surface of Type II-D Cas or other nucleic acid targeting moiety many non-native chemicals that can enhance the activity and modulate the effects of Type II-D Cas. A particularly powerful example of this is in the local modulation of the NHEJ/HDR pathway in cells. As is described in greater detail elsewhere herein, in some embodiments, donor polynucleotides and/or DSB repair mechanism modulator(s)

(e.g., HDR activators and/or NEHJ inhibitors can be attached to a Cas protein via sortase mediated ligation). It will be appreciated that such DSB repair mechanism modulators can also be attached to a Cas protein by other suitable methods, such as Gly-Ser linkers and others, described elsewhere herein. It will be appreciated that donor sequences can be attached via other approaches as well described in greater detail herein, such as HUH endonucleases.

Guide Molecules

The CRISPR-Cas or Cas-Based system described herein can, in some embodiments, include one or more guide molecules. The terms guide molecule and guide polynucleotide refer to polynucleotides, particularly RNA molecules capable of guiding a Cas to a target genomic locus and include a guide sequence (i.e., the reprogrammable region capable of being modified for site-specific binding of a target polynucleotide) and a direct repeat or scaffold that facilitates binding with the Cas protein and are used interchangeably as in foregoing cited documents such as International Patent Publication No. WO 2014/093622 (PCT/US2013/074667). In general, a guide sequence is any polynucleotide sequence having sufficient complementarity with a target polynucleotide sequence to hybridize with the target sequence and direct sequence-specific binding of a CRISPR complex to the target sequence. The guide molecule can be a polynucleotide. In some embodiments, each Cas protein included in the CRISPR-Cas system is coupled with, is configured to complex with, or is otherwise associated with its own guide molecule. In some embodiments, each Cas protein in a system composed of more than one Cas protein, each Cas protein is associated with a different guide molecule(s) than other Cas proteins within the same system.

In some embodiments, the guide molecule contains a region capable of hybridizing to a cleaved strand of the target polynucleotide and a region capable of hybridizing to a donor/insert polynucleotide. These can also be referred to as a splint or a bridge guide molecule or polynucleotide, as together, the regions capable of hybridizing the donor/insert and the target polynucleotide form splint or bridge when hybridized to the donor/insert polynucleotide and the target polynucleotide and hold them in proximity to one another for subsequent reactions to occur, such as ligation, between the two molecules. Thus, in some embodiments, the guide molecule can act as a splint or a bridge molecule when configured in this way.

In some embodiments the system includes two guide molecules that can each be splint or bridge molecules. In some embodiments, the first and second guide molecules comprise a region capable of hybridizing to a cleaved strand of the target polynucleotide and a region capable of hybridizing to the donor sequence. In some embodiments, the composition comprises a splint oligonucleotide that has a region capable of hybridizing to a cleaved strand of the target polynucleotide and a region capable of hybridizing to the donor molecule.

The ability of a guide sequence (within a nucleic acid-targeting guide RNA) to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay (Qui et al. 2004. BioTechniques. 36(4)702-707). Similarly, cleavage of a target nucleic acid sequence may be evaluated in a test tube by providing the target nucleic acid sequence, components of a nucleic acid-targeting complex, including the guide sequence to be tested and a control guide sequence different from the test guide sequence, and comparing binding or rate of cleavage at the target sequence between the test and control guide sequence reactions. Other assays are possible and will occur to those skilled in the art.

In some embodiments, the guide molecule is an RNA. The guide molecule(s) (also referred to interchangeably herein as guide polynucleotide and guide sequence) that are included in the CRISPR-Cas or Cas based system can be any polynucleotide sequence having sufficient complementarity with a target nucleic acid sequence to hybridize with the target nucleic acid sequence and direct sequence-specific binding of a nucleic acid-targeting complex to the target nucleic acid sequence. In some embodiments, the degree of complementarity, when optimally aligned using a suitable alignment algorithm, can be about or more than about 50%, 60%, 75%, 80%, 85%, 90%, 95%, 97.5%, 99%, or more. Optimal alignment may be determined with the use of any suitable algorithm for aligning sequences, non-limiting examples of which include the Smith-Waterman algorithm, the Needleman-Wunsch algorithm, algorithms based on the Burrows-Wheeler Transform (e.g., the Burrows Wheeler Aligner), Clustal W, Clustal X, BLAT, Novoalign (Novocraft Technologies; available at www.novocraft.com), ELAND (Illumina, San Diego, CA), SOAP (available at soap.genomics.org.com), and Maq (available at maq.sourceforge.net).

A guide sequence, and hence a nucleic acid-targeting guide, may be selected to target any target nucleic acid sequence. The target sequence may be DNA. The target sequence may be any RNA sequence. In some embodiments, the target sequence may be a sequence within an RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non-coding RNA (ncRNA), long non-coding RNA (lncRNA), and small cytoplasmatic RNA (scRNA). In some preferred embodiments, the target sequence may be a sequence within an RNA molecule selected from the group consisting of mRNA, pre-mRNA, and rRNA. In some preferred embodiments, the target sequence may be a sequence within an RNA molecule selected from the group consisting of ncRNA, and lncRNA. In some more preferred embodiments, the target sequence may be a sequence within an mRNA molecule or a pre-mRNA molecule.

In some embodiments, a nucleic acid-targeting guide is selected to reduce the degree secondary structure within the nucleic acid-targeting guide. In some embodiments, about or less than about 75%, 50%, 40%, 30%, 25%, 20%, 15%, 10%, 5%, 1%, or fewer of the nucleotides of the nucleic acid-targeting guide participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R.

Gruber et al., 2008, Cell 106(1): 23-24; and P A Carr and G M Church, 2009, Nature Biotechnology 27(12): 1151-62).

In some embodiments, the guide molecule is configured to minimize or reduce off-target effects. Guide sequences and strategies to minimize toxicity and off-target effects can be as in WO 2014/093622 (PCT/US2013/074667); or, via mutation as described herein.

In certain embodiments, a guide RNA or crRNA includes or is only composed of a direct repeat (DR) sequence and a guide sequence or spacer sequence. In certain embodiments, the guide RNA or crRNA includes or is only composed of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence.

In certain embodiments, the crRNA comprises a stem loop, preferably a single stem loop. In certain embodiments, the direct repeat sequence forms a stem loop, preferably a single stem loop.

In certain embodiments, the spacer length of the guide RNA is from 15 to 35 nt. In certain embodiments, the spacer length of the guide RNA is at least 15 nucleotides. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27 to 30 nt, e.g., 27, 28, 29, or 30 nt, from 30 to 35 nt, e.g., 30, 31, 32, 33, 34, or 35 nt, or 35 nt or longer.

The "tracrRNA" sequence or analogous terms includes any polynucleotide sequence that has sufficient complementarity with a crRNA sequence to hybridize. In some embodiments, the degree of complementarity between the tracrRNA sequence and crRNA sequence along the length of the shorter of the two when optimally aligned is about or more than about 25%, 30%, 40%, 50%, 60%, 70%, 80%, 90%, 95%, 97.5%, 99%, or higher. In some embodiments, the tracr sequence is about or more than about 5, 6, 7, 8, 9, 10, 11, 12, 13, 14, 15, 16, 17, 18, 19, 20, 25, 30, 40, 50, or more nucleotides in length. In some embodiments, the tracr sequence and crRNA sequence are contained within a single transcript, such that hybridization between the two produces a transcript having a secondary structure, such as a hairpin.

In general, degree of complementarity is with reference to the optimal alignment of the sca sequence and tracr sequence, along the length of the shorter of the two sequences. Optimal alignment may be determined by any suitable alignment algorithm and may further account for secondary structures, such as self-complementarity within either the sca sequence or tracr sequence. In some embodiments, the degree of complementarity between the tracr sequence and sca sequence along the length of the shorter of the two when optimally aligned is about or more than about 25%, 30%, 40%, 50%, 60%, 70%, 80%, 90%, 95%, 97.5%, 99%, or higher.

In some embodiments, the degree of complementarity between a guide sequence and its corresponding target sequence can be about or more than about 50%, 60%, 75%, 80%, 85%, 90%, 95%, 97.5%, 99%, or 100%; a guide or RNA or sgRNA can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length; or guide or RNA or sgRNA can be less than about 75, 50, 45, 40, 35, 30, 25, 20, 15, 12, or fewer nucleotides in length; and tracr RNA can be 30 or 50 nucleotides in length. In some embodiments, the degree of complementarity between a guide sequence and its corresponding target sequence is greater than 94.5% or 95% or 95.5% or 96% or 96.5% or 97% or 97.5% or 98% or 98.5% or 99% or 99.5% or 99.9%, or 100%. Off target is less than 100% or 99.9% or 99.5% or 99% or 99% or 98.5% or 98% or 97.5% or 97% or 96.5% or 96% or 95.5% or 95% or 94.5% or 94% or 93% or 92% or 91% or 90% or 89% or 88% or 87% or 86% or 85% or 84% or 83% or 82% or 81% or 80% complementarity between the sequence and the guide, with it being advantageous that off target is 100% or 99.9% or 99.5% or 99% or 99% or 98.5% or 98% or 97.5% or 97% or 96.5% or 96% or 95.5% or 95% or 94.5% complementarity between the sequence and the guide.

In some embodiments according to the invention, the guide RNA (capable of guiding Cas to a target locus) may comprise (1) a guide sequence capable of hybridizing to a genomic target locus in the eukaryotic cell; (2) a tracr sequence; and (3) a tracr mate sequence. All (1) to (3) may reside in a single RNA, i.e., an sgRNA (arranged in a 5' to 3' orientation), or the tracr RNA may be a different RNA than the RNA containing the guide and tracr sequence. The tracr hybridizes to the tracr mate sequence and directs the CRISPR/Cas complex to the target sequence. Where the tracr RNA is on a different RNA than the RNA containing the guide and tracr sequence, the length of each RNA may be optimized to be shortened from their respective native lengths, and each may be independently chemically modified to protect from degradation by cellular RNase or otherwise increase stability.

Many modifications to guide sequences are known in the art and are further contemplated within the context of this invention. Various modifications may be used to increase the specificity of binding to the target sequence and/or increase the activity of the Cas protein and/or reduce off-target effects. Example guide sequence modifications are described in International Patent Application No. PCT US2019/045582, specifically paragraphs [0178]-[0333], which is incorporated herein by reference as if expressed in its entirety herein.

Target Sequences, PAMs, and PFSs

Target Sequences

In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise RNA polynucleotides. The term "target RNA" refers to an RNA polynucleotide being or comprising the target sequence. In other words, the target polynucleotide can be a polynucleotide or a part of a polynucleotide to which a part of the guide sequence is designed to have complementarity with and to which the effector function mediated by the complex comprising the CRISPR effector protein and a guide molecule is to be directed. In some embodiments, a target sequence is located in the nucleus or cytoplasm of a cell.

The guide sequence can specifically bind a target sequence in a target polynucleotide. The target polynucleotide may be DNA. The target polynucleotide may be RNA. The target polynucleotide can have one or more (e.g., 1, 2, 3, 4, 5, 6, 7, 8, 9, 10, etc. or more) target sequences. The target polynucleotide can be on a vector. The target polynucleotide can be genomic DNA. The target polynucleotide can be episomal. Other forms of the target polynucleotide are described elsewhere herein.

The target sequence may be DNA. The target sequence may be any RNA sequence. In some embodiments, the target sequence may be a sequence within an RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non-coding RNA (ncRNA), long non-coding RNA (lncRNA), and small cytoplasmatic RNA (scRNA). In some preferred embodiments, the target sequence (also referred to herein as a target polynucleotide) may be a sequence within an RNA molecule selected from the group consisting of mRNA, pre-mRNA, and rRNA. In some preferred embodiments, the target sequence may be a sequence within an RNA molecule selected from the group consisting of ncRNA, and lncRNA. In some more preferred embodiments, the target sequence may be a sequence within an mRNA molecule or a pre-mRNA molecule.

PAM and PFS Elements

PAM elements are sequences that can be recognized and bound by Cas proteins. Cas proteins/effector complexes can then unwind the dsDNA at a position adjacent to the PAM element. It will be appreciated that Cas proteins and systems that include them that target RNA do not require PAM sequences (Marraffini et al. 2010. Nature. 463:568-571). Instead, many rely on PFSs, which are discussed elsewhere herein. In certain embodiments, the target sequence should be associated with a PAM (protospacer adjacent motif) or PFS (protospacer flanking sequence or site), that is, a short sequence recognized by the CRISPR complex. Depending on the nature of the CRISPR-Cas protein, the target sequence should be selected, such that its complementary sequence in the DNA duplex (also referred to herein as the non-target sequence) is upstream or downstream of the PAM. In the embodiments, the complementary sequence of the target sequence is downstream or 3' of the PAM or upstream or 5' of the PAM. The precise sequence and length requirements for the PAM differ depending on the Cas protein used, but PAMs are typically 2-5 base pair sequences adjacent the protospacer (that is, the target sequence). Examples of the natural PAM sequences for different Cas proteins are provided herein below and the skilled person will be able to identify further PAM sequences for use with a given Cas protein.

The ability to recognize different PAM sequences depends on the Cas polypeptide(s) included in the system. See e.g., Gleditzsch et al. 2019. RNA Biology. 16(4):504-517. Table 1 (from Gleditzsch et al. 2019) below shows several Cas polypeptides and the PAM sequence they recognize.

TABLE 1

Example PAM Sequences

| Cas Protein | PAM Sequence |
|---|---|
| SpCas9 | NGG/NRG |
| SaCas9 | NGRRT or NGRRN |
| NmeCas9 | NNNNGATT |
| CjCas9 | NNNNRYAC |
| StCas9 | NNAGAAW |
| Cas12a (Cpf1) (including LbCpf1 and AsCpf1) | TTTV |
| Cas12b (C2c1) | TTT, TTA, and TTC |
| Cas12c (C2c3) | TA |
| Cas12d (CasY) | TA |
| Cas12e (CasX) | 5'-TTCN-3' |

In some embodiments, the CRISPR effector protein may recognize a 3' PAM. In certain embodiments, the CRISPR effector protein may recognize a 3' PAM which is 5'H, wherein H is A, C or U.

Further, engineering of the PAM Interacting (PI) domain on the Cas protein may allow programing of PAM specificity, improve target site recognition fidelity, and increase the versatility of the CRISPR-Cas protein such as a Type II-D Cas of the present invention, for example as described for Cas9 in Kleinstiver B P et al. Engineered CRISPR-Cas9 nucleases with altered PAM specificities. Nature. 2015 Jul. 23; 523(7561):481-5. doi: 10.1038/nature14592. As further detailed herein, the skilled person will understand that Cas13 proteins may be modified analogously. Gao et al, "Engineered Cpf1 Enzymes with Altered PAM Specificities," bioRxiv 091611; doi: http://dx.doi.org/10.1101/091611 (Dec. 4, 2016). Doench et al. created a pool of sgRNAs, tiling across all possible target sites of a panel of six endogenous mouse and three endogenous human genes and quantitatively assessed their ability to produce null alleles of their target gene by antibody staining and flow cytometry. The authors showed that optimization of the PAM improved activity and also provided an on-line tool for designing sgRNAs.

PAM sequences can be identified in a polynucleotide using an appropriate design tool, which are commercially available as well as online. Such freely available tools include, but are not limited to, CRISPRFinder and CRISPRTarget. Mojica et al. 2009. Microbiol. 155(Pt. 3):733-740; Atschul et al. 1990. J. Mol. Biol. 215:403-410; Biswas et al. 2013 RNA Biol. 10:817-827; and Grissa et al. 2007. Nucleic Acid Res. 35:W52-57. Experimental approaches to PAM identification can include, but are not limited to, plasmid depletion assays (Jiang et al. 2013. Nat. Biotechnol. 31:233-239; Esvelt et al. 2013. Nat. Methods. 10:1116-1121; Kleinstiver et al. 2015. Nature. 523:481-485), screened by a high-throughput in vivo model called PAM-SCNAR (Pattanayak et al. 2013. Nat. Biotechnol. 31:839-843 and Leenay et al. Mol. Cell. 2016. 62(1):137-147 pubmed.ncbi.nlm.nih.gov/27041224/, and negative screening (Zetsche et al. 2015. Cell. 163:759-771).

As previously mentioned, CRISPR-Cas systems that target RNA do not typically rely on PAM sequences. Instead, such systems typically recognize protospacer flanking sites (PFSs) instead of PAMs Thus, Type VI CRISPR-Cas systems typically recognize protospacer flanking sites (PFSs) instead of PAMs. PFSs represents an analogue to PAMs for RNA targets. Type VI CRISPR-Cas systems employ a Cas13. Some Cas13 proteins analyzed to date, such as Cas13a (C2c2) identified from Leptotrichia shahii (LShCAs13a) have a specific discrimination against G at the 3'end of the target RNA. The presence of a C at the corresponding crRNA repeat site can indicate that nucleotide pairing at this position is rejected. However, some Cas13 proteins (e.g., LwaCAs13a and PspCas13b) do not seem to have a PFS preference. See e.g., Gleditzsch et al. 2019. RNA Biology. 16(4):504-517.

Some Type VI proteins, such as subtype B, have 5'-recognition of D (G, T, A) and a 3'-motif requirement of NAN or NNA. One example is the Cas13b protein identified in Bergeyella zoohelcum (BzCas13b). See e.g., Gleditzsch et al. 2019. RNA Biology. 16(4):504-517.

Overall Type VI CRISPR-Cas systems appear to have less restrictive rules for substrate (e.g., target sequence) recognition than those that target DNA (e.g., Type V and type II).

Nucleus Targeting and Transportation

In some embodiments, one or more components (e.g., the Cas protein and/or deaminase) in the composition for engineering cells may comprise one or more sequences related to nucleus targeting and transportation. Such sequence may facilitate the one or more components in the composition for targeting a sequence within a cell. In order to improve targeting of the CRISPR-Cas protein and/or the nucleotide deaminase protein or catalytic domain thereof used in the methods of the present disclosure to the nucleus, it may be advantageous to provide one or both of these components with one or more nuclear localization sequences (NLSs).

In some embodiments, the NLSs used in the context of the present disclosure are heterologous to the proteins. Non-limiting examples of NLSs include an NLS sequence derived from: the NLS of the SV40 virus large T-antigen, having the amino acid sequence PKKKRKV (SEQ ID NO: 4) or PKKKRKVEAS (SEQ ID NO: 5); the NLS from nucleoplasmin (e.g., the nucleoplasmin bipartite NLS with the sequence KRPAATKKAGQAKKKK (SEQ ID NO:6)); the c-myc NLS having the amino acid sequence PAAKRVKLD (SEQ ID NO: 7) or RQRRNELKRSP (SEQ ID NO: 8); the hRNPA1 M9 NLS having the sequence NQSSNFGPMKGGNFGGRSSGPYGGGGQYFAK-PRNQGGY (SEQ ID NO: 9); the sequence RMRIZFKNKGKDTAELRRRRVEVSVELRKAKKD-EQILKRRNV (SEQ ID NO: 10) of the IBB domain from importin-alpha; the sequences VSRKRPRP (SEQ ID NO: 11) and PPKKARED (SEQ ID NO: 12) of the myoma T protein; the sequence POPKKKPL (SEQ ID NO: 13) of human p53; the sequence SALIKKKKMAP (SEQ ID NO: 14) of mouse c-abl IV; the sequences DRLRR (SEQ ID NO: 15) and PKQKKRK (SEQ ID NO: 16) of the influenza virus NS1; the sequence RKLKKKIKKL (SEQ ID NO: 17) of the Hepatitis virus delta antigen; the sequence REKKKFLKRR (SEQ ID NO: 18) of the mouse Mx1 protein; the sequence KRKGDEVDGVDEVAKKKSKK (SEQ ID NO: 19) of the human poly(ADP-ribose) polymerase; and the sequence RKCLQAGMNLEARKTKK (SEQ ID NO: 20) of the steroid hormone receptors (human) glucocorticoid. In general, the one or more NLSs are of sufficient strength to drive accumulation of the DNA-targeting Cas protein in a detectable amount in the nucleus of a eukaryotic cell. In general, strength of nuclear localization activity may derive from the number of NLSs in the CRISPR-Cas protein, the particular NLS(s) used, or a combination of these factors. Detection of accumulation in the nucleus may be performed by any suitable technique. For example, a detectable marker may be fused to the nucleic acid-targeting protein, such that location within a cell may be visualized, such as in combination with a means for detecting the location of the nucleus (e.g., a stain specific for the nucleus such as DAPI). Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of nucleic acid-targeting complex formation (e.g., assay for deaminase activity) at the target sequence, or assay for altered gene expression activity affected by DNA-targeting complex formation and/or DNA-targeting), as compared to a control not exposed to the CRISPR-Cas protein and deaminase protein, or exposed to a CRISPR-Cas and/or deaminase protein lacking the one or more NLSs.

The CRISPR-Cas and/or nucleotide deaminase proteins may be provided with 1 or more, such as with, 2, 3, 4, 5, 6, 7, 8, 9, 10, or more heterologous NLSs. In some embodiments, the proteins comprises about or more than about 1, 2, 3, 4, 5, 6, 7, 8, 9, 10, or more NLSs at or near the amino-terminus, about or more than about 1, 2, 3, 4, 5, 6, 7, 8, 9, 10, or more NLSs at or near the carboxy-terminus, or a combination of these (e.g., zero or at least one or more NLS at the amino-terminus and zero or at one or more NLS at the carboxy terminus). When more than one NLS is present, each may be selected independently of the others, such that a single NLS may be present in more than one copy and/or in combination with one or more other NLSs present in one or more copies. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. In preferred embodiments of the CRISPR-Cas proteins, an NLS attached to the C-terminal of the protein.

In certain embodiments, the CRISPR-Cas protein and the deaminase protein are delivered to the cell or expressed within the cell as separate proteins. In these embodiments, each of the CRISPR-Cas and deaminase protein can be provided with one or more NLSs as described herein. In certain embodiments, the CRISPR-Cas and deaminase proteins are delivered to the cell or expressed with the cell as a fusion protein. In these embodiments one or both of the CRISPR-Cas and deaminase protein is provided with one or more NLSs. Where the nucleotide deaminase is fused to an adaptor protein (such as MS2) as described above, the one or more NLS can be provided on the adaptor protein, provided that this does not interfere with aptamer binding. In particular embodiments, the one or more NLS sequences may also function as linker sequences between the nucleotide deaminase and the CRISPR-Cas protein.

In certain embodiments, guides of the disclosure comprise specific binding sites (e.g. aptamers) for adapter proteins, which may be linked to or fused to a nucleotide deaminase or catalytic domain thereof. When such a guide forms a CRISPR complex (e.g., CRISPR-Cas protein binding to guide and target), the adapter proteins bind and the nucleotide deaminase or catalytic domain thereof associated with the adapter protein is positioned in a spatial orientation which is advantageous for the attributed function to be effective.

The skilled person will understand that modifications to the guide which allow for binding of the adapter+nucleotide deaminase, but not proper positioning of the adapter+nucleotide deaminase (e.g., due to steric hindrance within the three-dimensional structure of the CRISPR complex) are modifications which are not intended. The one or more modified guide may be modified at the tetra loop, the stem loop 1, stem loop 2, or stem loop 3, as described herein, preferably at either the tetra loop or stem loop 2, and in some cases at both the tetra loop and stem loop 2.

In some embodiments, a component (e.g., the dead Cas protein, the nucleotide deaminase protein or catalytic domain thereof, or a combination thereof) in the systems may comprise one or more nuclear export signals (NES), one or more nuclear localization signals (NLS), or any combinations thereof. In some cases, the NES may be an HIV Rev NES. In certain cases, the NES may be MAPK NES. When the component is a protein, the NES or NLS may be at the C terminus of component. Alternatively or additionally, the NES or NLS may be at the N terminus of component. In some examples, the Cas protein and optionally said nucleotide deaminase protein or catalytic domain thereof comprise one or more heterologous nuclear export signal(s) (NES(s)) or nuclear localization signal(s) (NLS(s)), preferably an HIV Rev NES or MAPK NES, preferably C-terminal.

Templates

In some embodiments, the composition for engineering cells comprise a template, e.g., a recombination or repair template or simply template. A template nucleic acid, as that term is used herein, refers to a nucleic acid sequence which can be used in conjunction with a Cas or an ortholog or homolog thereof, preferably a Cas molecule and a guide RNA molecule to alter the structure of a target position. The template nucleic acid may comprise a template sequence. The template nucleic acid may be comprised in the guide molecule. In an embodiment, the target nucleic acid is modified to have some or all of the sequence of the template nucleic acid, typically at or near cleavage site(s). In an embodiment, the template nucleic acid is single stranded. In an alternate embodiment, the template nucleic acid is double stranded. In an embodiment, the template nucleic acid is DNA, e.g., double stranded DNA. In an alternate embodiment, the template nucleic acid is single stranded DNA.

A template may be a component of another vector as described herein, contained in a separate vector, or provided as a separate polynucleotide. In some embodiments, a recombination template is designed to serve as a template in homologous recombination, such as within or near a target sequence nicked or cleaved by a nucleic acid-targeting effector protein as a part of a nucleic acid-targeting complex.

In some embodiments, the template sequence is integrated or part of a guide molecule. In some embodiments, the template sequence is positioned at the 3' end of a guide molecule. In some embodiments, the template sequence is positioned at the 5' end of a guide molecule.

In some embodiments, the template sequence is attached or otherwise coupled (e.g., via a linker or other tether molecule to a Cas protein of the CRISPR-Cas system or other component thereof. Suitable linkers and tethers are described in greater detail elsewhere herein, such as in connection with donor polynucleotides and/or accessory molecules.

In an embodiment, the template nucleic acid alters the sequence of the target position. In an embodiment, the template nucleic acid results in the incorporation of a modified, or non-naturally occurring base into the target nucleic acid.

The template sequence may undergo a breakage mediated or catalyzed recombination with the target sequence. In an embodiment, the template nucleic acid may include sequence that corresponds to a site on the target sequence that is cleaved by a Cas protein mediated cleavage event. In an embodiment, the template nucleic acid may include a sequence that corresponds to both, a first site on the target sequence that is cleaved in a first Cas protein mediated event, and a second site on the target sequence that is cleaved in a second Cas protein mediated event.

In certain embodiments, the template nucleic acid can include a sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation. In certain embodiments, the template nucleic acid can include a sequence which results in an alteration in a non-coding sequence, e.g., an alteration in an exon or in a 5' or 3' non-translated or non-transcribed region. Such alterations include an alteration in a control element, e.g., a promoter, enhancer, and an alteration in a cis-acting or trans-acting control element.

A template nucleic acid having homology with a target position in a target gene may be used to alter the structure of a target sequence. The template sequence may be used to alter an unwanted structure, e.g., an unwanted or mutant nucleotide. The template nucleic acid may include a sequence which, when integrated, results in decreasing the activity of a positive control element; increasing the activity of a positive control element; decreasing the activity of a negative control element; increasing the activity of a negative control element; decreasing the expression of a gene; increasing the expression of a gene; increasing resistance to a disorder or disease; increasing resistance to viral entry; correcting a mutation or altering an unwanted amino acid residue conferring, increasing, abolishing or decreasing a biological property of a gene product, e.g., increasing the enzymatic activity of an enzyme, or increasing the ability of a gene product to interact with another molecule.

The template nucleic acid may include a sequence which results in a change in sequence of 1, 2, 3, 4, 5, 6, 7, 8, 9, 10, 11, 12 or more nucleotides of the target sequence.

A template polynucleotide may be of any suitable length, such as about or more than about 10, 15, 20, 25, 50, 75, 100, 150, 200, 500, 1000, or more nucleotides in length. In an embodiment, the template nucleic acid may be 20+/−10, 30+/−10, 40+/−10, 50+/−10, 60+/−10, 70+/−10, 80+/−10, 90+/−10, 100+/−10, 110+/−10, 120+/−10, 130+/−10, 140+/−10, 150+/−10, 160+/−10, 170+/−10, 180+/−10, 190+/−10, 200+/−10, 210+/−10, of 220+/−10 nucleotides in length. In an embodiment, the template nucleic acid may be 30+/−20, 40+/−20, 50+/−20, 60+/−20, 70+/−20, 80+/−20, 90+/−20, 100+/−20, 110+/−20, 120+/−20, 130+/−20, 140+/−20, 150+/−20, 160+/−20, 170+/−20, 180+/−20, 190+/−20, 200+/−20, 210+/−20, of 220+/−20 nucleotides in length. In an embodiment, the template nucleic acid is 10 to 1,000, 20 to 900, 30 to 800, 40 to 700, 50 to 600, 50 to 500, 50 to 400, 50 to 300, 50 to 200, or 50 to 100 nucleotides in length.

In some embodiments, the template polynucleotide is complementary to a portion of a polynucleotide comprising the target sequence. When optimally aligned, a template polynucleotide might overlap with one or more nucleotides of a target sequences (e.g., about or more than about 1, 5, 10, 15, 20, 25, 30, 35, 40, 45, 50, 60, 70, 80, 90, 100 or more nucleotides). In some embodiments, when a template sequence and a polynucleotide comprising a target sequence are optimally aligned, the nearest nucleotide of the template polynucleotide is within about 1, 5, 10, 15, 20, 25, 50, 75, 100, 200, 300, 400, 500, 1000, 5000, 10000, or more nucleotides from the target sequence.

The exogenous polynucleotide template comprises a sequence to be integrated (e.g., a mutated gene). The sequence for integration may be a sequence endogenous or exogenous to the cell. Examples of a sequence to be integrated include polynucleotides encoding a protein or a non-coding RNA (e.g., a microRNA). Thus, the sequence for integration may be operably linked to an appropriate control sequence or sequences. Alternatively, the sequence to be integrated may provide a regulatory function.

An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000.

An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000.

In certain embodiments, one or both homology arms may be shortened to avoid including certain sequence repeat elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In some methods, the exogenous polynucleotide template may further comprise a marker. Such a marker may make it easy to screen for targeted integrations. Examples of suitable markers include restriction sites, fluorescent proteins, or selectable markers. The exogenous polynucleotide template of the disclosure can be constructed using recombinant techniques (see, for example, Sambrook et al., 2001 and Ausubel et al., 1996).

In certain embodiments, a template nucleic acid for correcting a mutation may designed for use as a single-stranded oligonucleotide. When using a single-stranded oligonucleotide, 5' and 3' homology arms may range up to about 200 base pairs (bp) in length, e.g., at least 25, 50, 75, 100, 125, 150, 175, or 200 bp in length.

Suzuki et al. describe in vivo genome editing via CRISPR/Cas9 mediated homology-independent targeted integration (2016, Nature 540:144-149), which can be adapted for use with the Type II-D Cas proteins and systems thereof of the present invention.

Accessory Molecules

Additional accessory molecules, such as additional CRISPR effectors and/or other accessory molecules can be included in the nucleic acid targeting systems described herein in addition to the Cas polypeptides described elsewhere herein. In some embodiments, the accessory molecules can be other effector and/or targeting proteins or molecules. Accessory molecules can be or be derived from a Type I, II, III, IV, V, CRISPR-Cas system. The accessory molecules can modify or modulate Cas or other CRISPR-Cas system component function or activity.

In certain embodiments, an accessory molecule can be identified by their proximity to a Cas gene and/or a CRISPR array (e.g., within the region 20 kb from the start of the Cas gene and/or CRISPR array). Non-limiting examples of Cas proteins that can be included as accessory molecules in the Type II-D Cas or system thereof of the present invention include, but are not limited to, Cas1, Cas1B, Cas2, Cas3, Cas4, Cas5, Cas6, Cas7, Cas8, Cas9 (also known as Csn1 and Csx12), Cas10, Cas12 (also known as Cpf1), Cas13, Cas 14, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, C2c2, homologues thereof, orthologues thereof, or modified versions thereof. The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of. Homologous proteins may but need not be structurally related or are only partially structurally related. An "orthologue" of a protein as used herein is a protein of a different species which performs the same or a similar function as the protein it is an orthologue of. Orthologous proteins may, but need not be structurally related, or are only partially structurally related. Such definition applies throughout this specification.

In some embodiments, one or more elements of a nucleic acid-targeting system is derived from a particular organism comprising an endogenous RNA-targeting system. In particular embodiments, the Type VI RNA-targeting Cas enzyme is C2c2. In an embodiment of the invention, there is provided a effector protein which comprises an amino acid sequence having at least 80% sequence homology to the wild-type sequence of any of Leptotrichia shahii C2c2, Lachnospiraceae bacterium MA2020 C2c2, Lachnospiraceae bacterium NK4A179 C2c2, Clostridium aminophilum (DSM 10710) C2c2, Carnobacterium gallinarum (DSM 4847) C2c2, Paludibacter propionicigenes (WB4) C2c2, Listeria weihenstephanensis (FSL R9-0317) C2c2, Listeriaceae bacterium (FSL M6-0635) C2c2, Listeria newyorkensis (FSL M6-0635) C2c2, Leptotrichia wadei (F0279) C2c2, Rhodobacter capsulatus (SB 1003) C2c2, Rhodobacter capsulatus (R121) C2c2, Rhodobacter capsulatus (DE442) C2c2, Leptotrichia wadei (Lw2) C2c2, or Listeria seeligeri C2c2.

In an embodiment of the invention, an accessory protein enhances an activity of a CRISPR protein. In certain embodiments, the accessory protein inhibits an activity of a CRISPR protein.

According to the invention, naturally occurring accessory proteins of Type II CRISPR systems comprise small proteins encoded at or near a CRISPR locus that function to modify an activity of a CRISPR protein. In general, a CRISPR locus can be identified as comprising a putative CRISPR array and/or encoding a putative CRISPR effector protein. In an embodiment, an effector protein can be from 600 to 2000 amino acids, or from 600 to 1800 amino acids, or from 650 to 1300 amino acids. In an embodiment, an accessory protein can be encoded within 25 kb, or within 20 kb or within 15 kb, or within 10 kb of a putative CRISPR effector protein or array, or from 2 kb to 10 kb from a putative CRISPR effector protein or array.

In an embodiment of the invention, an accessory protein is from 50 to 300 amino acids, or from 100 to 300 amino acids or from 150 to 250 amino acids or about 200 amino acids.

Identification and use of a CRISPR accessory protein of the invention is independent of CRISPR effector protein classification. Accessory proteins of the invention can be found in association with or engineered to function with a variety of CRISPR effector proteins. Examples of accessory proteins identified and used herein are representative of CRISPR effector proteins generally. It is understood that CRISPR effector protein classification may involve homology, feature location, nucleic acid target (e.g. DNA or RNA), absence or presence of tracr RNA, location of guide/spacer sequence 5' or 3' of a direct repeat, or other criteria. In embodiments of the invention, accessory protein identification and use transcend such classifications.

According to the invention, in certain embodiments, enhancing activity of a Type II Cas protein or complex thereof comprises contacting the Type II Cas protein or complex thereof with an accessory protein from the same organism that activates the Cas protein. In other embodiments, enhancing activity of a Type II Cas protein of complex thereof comprises contacting the Type II Cas protein or complex thereof with an activator accessory protein from a different organism within the same subclass (e.g., Type II). In other embodiments, enhancing activity of a Type II Cas protein or complex thereof comprises contacting the Type II Cas protein or complex thereof with an accessory protein not within the subclass.

According to the invention, in certain embodiments, repressing activity of a Type II Cas protein or complex thereof comprises contacting the Type II Cas protein or complex thereof with an accessory protein from the same organism that represses the Cas protein. In other embodiments, repressing activity of a Type II Cas protein or complex thereof comprises contacting the Type II Cas protein or complex thereof with a repressor accessory protein from a different organism within the same subclass (e.g., Type II-D). In other embodiments, repressing activity of a Type II Cas protein or complex thereof comprises contacting the Type II Cas protein or complex thereof with a repressor accessory protein not within the subclass (e.g., a Type II Cas protein other than Type II-B with a Type II-B repressor accessory protein or vice-versa).

In certain embodiments where the Type II Cas protein and the Type II accessory protein are from the same organism, the two proteins will function together in an engineered CRISPR system. In certain embodiments, it will be desirable to alter the function of the engineered CRISPR system, for example by modifying either or both of the proteins or their expression. In embodiments where the Type II Cas protein and the Type II accessory protein are from different organisms which may be within the same class or different classes, the proteins may function together in an engineered CRISPR system but it will often be desired or necessary to modify either or both of the proteins to function together.

Accordingly, in certain embodiments of the invention either or both of a Cas protein and an accessory protein may be modified to adjust aspects of protein-protein interactions between the Cas protein and accessory protein. In certain embodiments, either or both of a Cas protein and an accessory protein may be modified to adjust aspects of protein-nucleic acid interactions. Ways to adjust protein-protein interactions and protein-nucleic acid interaction include without limitation, fitting molecular surfaces, polar interactions, hydrogen bonds, and modulating van der Waals interactions. In certain embodiments, adjusting protein-protein interactions or protein-nucleic acid binding comprises increasing or decreasing binding interactions. In certain embodiments, adjusting protein-protein interactions or protein-nucleic acid binding comprises modifications that favor or disfavor a conformation of the protein or nucleic acid.

By "fitting", is meant determining including by automatic, or semi-automatic means, interactions between one or more atoms of a Cas protein (and optionally at least one atoms of a Cas accessory protein), or between one or more atoms of a Cas protein and one or more atoms of a nucleic acid (or optionally between one or more atoms of a Cas accessory protein and a nucleic acid), and calculating the extent to which such interactions are stable. Interactions include attraction and repulsion, brought about by charge, steric considerations and the like.

The three-dimensional structure of Type II CRISPR protein or complex thereof (and/or a Type II CRISPR accessory protein or complex thereof in the context of Casb) provides in the context of the instant invention an additional tool for identifying additional mutations in orthologs of Cas. The crystal structure can also be basis for the design of new and specific Cass (and optionally Cas accessory proteins). Various computer-based methods for fitting are described further. Binding interactions of Cass (and optionally accessory proteins), and nucleic acids can be examined through the use of computer modeling using a docking program. Docking programs are known; for example GRAM, DOCK or AUTODOCK (see Walters et al. Drug Discovery Today, vol. 3, no. 4 (1998), 160-178, and Dunbrack et al. Folding and Design 2 (1997), 27-42). This procedure can include computer fitting to ascertain how well the shape and the chemical structure of the binding partners. Computer-assisted, manual examination of the active site or binding site of a Type II system may be performed. Programs such as GRID (P. Goodford, J. Med. Chem, 1985, 28, 849-57)—a program that determines probable interaction sites between molecules with various functional groups—may also be used to analyze the active site or binding site to predict partial structures of binding compounds. Computer programs can be employed to estimate the attraction, repulsion or steric hindrance of the two binding partners, e.g., components of a Type II CRISPR system, or a nucleic acid molecule and a component of a Type II CRISPR system. Amino acid substitutions may be made on the basis of differences or similarities in amino acid properties (such as polarity, charge, solubility, hydrophobicity, hydrophilicity, and/or the amphipathic nature of the residues) and it is therefore useful to group amino acids together in functional groups. Amino acids may be grouped together based on the properties of their side chains alone. In comparing orthologs, there are likely to be residues conserved for structural or catalytic reasons. These sets may be described in the form of a Venn diagram (Livingstone C. D. and Barton G. J. (1993) "Protein sequence alignments: a strategy for the hierarchical analysis of residue conservation" Comput. Appl. Biosci. 9: 745-756) (Taylor W. R. (1986) "The classification of amino acid conservation" J. Theor. Biol. 119; 205-218). Conservative substitutions may be made, for example according to the table below which describes a generally accepted Venn diagram grouping of amino acids (see Table 2 below).

TABLE 2

| Set | | Sub-set | |
|---|---|---|---|
| Hydrophobic | F W Y H K M I L V A G C (SEQ ID NO: 21) | Aromatic | F W Y H (SEQ ID NO: 22) |
| | | Aliphatic | I L V |
| Polar | W Y H K R E D C S T N Q (SEQ ID NO: 23) | Charged | H K R E D (SEQ ID NO: 24) |
| | | Positively charged | H K R |
| | | Negatively charged | E D |
| Small | V C A G S P I N D (SEQ ID NO: 25) | Tiny | A G S |

In some embodiments, the modifications in Cas may comprise modification of one or more amino acid residues of the Cas protein. In some embodiments, the modifications in Cas may comprise modification of one or more amino acid residues located in a region which comprises residues which are positively charged in the unmodified Cas protein (and/or Cas accessory protein). In some embodiments, the modifications in Cas may comprise modification of one or more amino acid residues which are positively charged in the unmodified Cas protein (and/or Cas accessory protein). In some embodiments, the modifications in Cas may comprise modification of one or more amino acid residues which are not positively charged in the unmodified Cas protein (and/or Cas accessory protein). The modification may comprise modification of one or more amino acid residues which are uncharged in the unmodified Cas protein (and/or Cas accessory protein). The modification may comprise modification of one or more amino acid residues which are negatively charged in the unmodified Cas protein (and/or Cas accessory protein). The modification may comprise modification of one or more amino acid residues which are hydrophobic in the unmodified Cas protein (and/or Cas accessory protein). The modification may comprise modification of one or more amino acid residues which are polar in the unmodified Cas protein (and/or Cas accessory protein). The modification may comprise substitution of a hydrophobic amino acid or polar amino acid with a charged amino acid, which can be a negatively charged or positively charged amino acid. The modification may comprise substitution of a negatively charged amino acid with a positively charged or polar or hydrophobic amino acid. The modification may comprise substitution of a positively charged amino acid with a negatively charged or polar or hydrophobic amino acid.

Embodiments herein also include sequences (both polynucleotide or polypeptide) which may comprise homologous substitution (substitution and replacement are both used herein to mean the interchange of an existing amino acid residue or nucleotide, with an alternative residue or nucleotide) that may occur i.e., like-for-like substitution in the case of amino acids such as basic for basic, acidic for acidic, polar for polar, etc. Non-homologous substitution may also occur i.e., from one class of residue to another or alternatively involving the inclusion of unnatural amino acids such as ornithine (hereinafter referred to as Z), diaminobutyric acid ornithine (hereinafter referred to as B), norleucine ornithine (hereinafter referred to as O), pyriylalanine, thienylalanine, naphthylalanine and phenylglycine. Variant amino acid sequences may include suitable spacer groups that may be inserted between any two amino acid residues of the sequence including alkyl groups such as methyl, ethyl or propyl groups in addition to amino acid spacers such as glycine or β-alanine residues. A further form of variation, which involves the presence of one or more amino acid residues in peptoid form, may be well understood by those skilled in the art. For the avoidance of doubt, "the peptoid form" is used to refer to variant amino acid residues wherein the α-carbon substituent group is on the residue's nitrogen atom rather than the α-carbon. Processes for preparing peptides in the peptoid form are known in the art, for example Simon R J et al., PNAS (1992) 89(20), 9367-9371 and Horwell D C, Trends Biotechnol. (1995) 13(4), 132-134.

Corresponding residues in other Cas orthologs can be identified by the methods of Zhang et al., 2012 (Nature; 490(7421): 556-60) and Chen et al., 2015 (PLoS Comput Biol; 11(5): e1004248).

Adaptors and Additional Functional Domains

In certain embodiments, and as is also described elsewhere herein, the CRISPR-Cas system described herein can include on or more adaptor proteins. In certain embodiments, the adaptor protein can bind to RNA. The adaptor proteins can be capable of recruitment of, for example, effector proteins or fusions that can have one or more functional domains. In some embodiments, one or more proteins of the CRISPR-Cas system, such as a Cas protein can include one or more additional or modified functional domains. In some embodiments, the functional domain is a transcriptional activation domain, preferably VP64. In some embodiments, the functional domain is a transcription repression domain, preferably KRAB. In some embodiments, the transcription repression domain is SID, or concatemers of SID (e.g., SID4X). In some embodiments, the functional domain is an epigenetic modifying domain, such that an epigenetic modifying enzyme is provided. In some embodiments, the functional domain is an activation domain, which may be the P65 activation domain.

The adaptor proteins may include to orthogonal RNA-binding protein/aptamer combinations that exist within the diversity of bacteriophage coat proteins. A list of such coat proteins includes, but is not limited to: Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1.

The functional domain can be, for example, one or more domains from the group consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g. light inducible). In some embodiments, the functional domain may be selected from the group of: transposase domain, integrase domain, recombinase domain, resolvase domain, invertase domain, protease domain, DNA methyltransferase domain, DNA hydroxylmethylase domain, DNA demethylase domain, histone acetylase domain, histone deacetylases domain, nuclease domain, repressor domain, activator domain, nuclear-localization signal domains, transcription-regulatory protein (or transcription complex recruiting) domain, cellular uptake activity associated domain, nucleic acid binding domain, antibody presentation domain, histone modifying enzymes, recruiter of histone modifying enzymes; inhibitor of histone modifying enzymes, histone methyltransferase, histone demethylase, histone kinase, histone phosphatase, histone ribosylase, histone deribosylase, histone ubiquitinase, histone deubiquitinase, histone biotinase and histone tail protease.

Endogenous transcriptional repression is often mediated by chromatin modifying enzymes such as histone methyltransferases (HMTs) and deacetylases (HDACs). Repressive histone effector domains are known and an exemplary list is provided below. In the exemplary table, preference was given to proteins and functional truncations of small size to facilitate efficient viral packaging (for instance via AAV). In general, however, the domains may include HDACs, histone methyltransferases (HMTs), and histone acetyltransferase (HAT) inhibitors, as well as HDAC and HMT recruiting proteins. The functional domain may be or include, in some embodiments, HDAC Effector Domains, HDAC Recruiter Effector Domains, Histone Methyltransferase (HMT) Effector Domains, Histone Methyltransferase (HMT) Recruiter Effector Domains, or Histone Acetyltransferase Inhibitor Effector Domains. Tables 3-7 below show exemplary chromatin modifying enzymes and/or domains.

TABLE 3

HDAC Effector Domains

| Subtype/Complex | Name | Substrate (if known) | Modification (if known) | Organism | Full size (aa) | Selected truncation (aa) | Final size (aa) | Catalytic domain |
|---|---|---|---|---|---|---|---|---|
| HDAC I | HDAC8 | — | — | X. laevis | 325 | 1-325 | 325 | 1-272: HDAC |
| HDAC I | RPD3 | — | — | S. cerevisiae | 433 | 19-340 | 322 (Vannier) | 19-331: HDAC |
| HDAC IV | MesoLo4 | — | — | M. loti | 300 | 1-300 (Gregoretti) | 300 | — |
| HDAC IV | HDAC11 | — | — | H. sapiens | 347 | 1-347 (Gao) | 347 | 14-326: HDAC |
| HD2 | HDT1 | — | — | A. thaliana | 245 | 1-211 (Wu) | 211 | — |
| SIRT I | SIRT3 | H3K9Ac H4K16Ac H3K56Ac | — | H. sapiens | 399 | 143-399 (Scher) | 257 | 126-382: SIRT |
| SIRT I | HST2 | — | — | C. albicans | 331 | 1-331 (Hnisz) | 331 | — |
| SIRT I | CobB | — | — | E. coli (K12) | 242 | 1-242 (Landry) | 242 | — |
| SIRT I | HST2 | — | — | S. cerevisiae | 357 | 8-298 (Wilson) | 291 | — |
| SIRT III | SIRT5 | H4K8Ac H4K16Ac | — | H. sapiens | 310 | 37-310 (Gertz) | 274 | 41-309: SIRT |
| SIRT III | Sir2A | — | — | P. falciparum | 273 | 1-273 (Zhu) | 273 | 19-273: SIRT |
| SIRT IV | SIRT6 | H3K9Ac H3K56Ac | — | H. sapiens | 355 | 1-289 (Tennen) | 289 | 35-274: SIRT |

Accordingly, the repressor domains of the present invention may be selected from histone methyltransferases (HMNTs), histone deacetylases (HIDACs), histone acetyltransferase (HAT) inhibitors, as well as THDAC and HMNT recruiting proteins.

The THDAC domain may be any of those in the table above, namely: HIDAC8, RPD3, MesoLo4, DAC11, HIDT1, SIRT3, HST2, CobB, HST2, SIRT5, Sir2A, or SIRT6.

TABLE 4

HDAC Recruiter Effector Domains

| Subtype/Complex | Name | Substrate (if known) | Modification (if known) | Organism | Full size (aa) | Selected truncation (aa) | Final size (aa) | Catalytic domain |
|---|---|---|---|---|---|---|---|---|
| Sin3a | MeCP2 | — | — | R. norvegicus | 492 | 207-492 (Nan) | 286 | — |
| Sin3a | MBD2b | — | — | H. sapiens | 262 | 45-262 (Boeke) | 218 | — |
| Sin3a | Sin3a | — | — | H. sapiens | 1273 | 524-851 (Laherty) | 328 | 627-829: HDAC1 interaction |
| NcoR | NcoR | — | — | H. sapiens | 2440 | 420-488 (Zhang) | 69 | — |
| NuRD | SALL1 | — | — | M. musculus | 1322 | 1-93 (Lauberth) | 93 | — |
| CoREST | RCOR1 | — | — | H. sapiens | 482 | 81-300 (Gu, Ouyang) | 220 | — |

In some embodiments, the functional domain may be a DAC Recruiter Effector Domain. Preferred examples includethose in the Table(s) below, namely MeCP2, MBD2b, Sin3a, NcoR, SALL1, RCOR1. NcoR is exemplified in the present Examples and, although preferred, it is envisaged that others in the class will also be useful.

In some embodiments, the functional domain may be a Methyltransferase (n T) Effector Domain. Preferred examples include those in the Table(s) below, namely NUE, vSET, EHMT2/G9A, SUV39H1, dim-5, KYP, SUVR4, SET4, SET1, SETD8, and TgSET8. NUE is exemplified in the present Examples and, although preferred, it is envisaged that others in the class will also be useful.

TABLE 5

Histone Methyltransferase (HMT) Effector Domains

| Subtype/Complex | Name | Substrate (if known) | Modification (if known) | Organism | Full size (aa) | Selected truncation (aa) | Final size (aa) | Catalytic domain |
|---|---|---|---|---|---|---|---|---|
| SET | NUE | H2B, H3, H4 | — | C. trachomatis | 219 | 1-219 (Pennini) | 219 | — |
| SET | vSET | — | H3K27me3 | P. bursaria chlorella virus | 119 | 1-119 (Mujtaba) | 119 | 4-112: SET2 |
| SUV39 family | EHMT2/G9A | H1.4K2, H3K9, H3K27 | H3K9me1/2, HlK25me1 | M. musculus | 1263 | 969-1263 (Tachibana) | 295 | 1025-1233: preSET, SET, postSET |
| SUV39 | SUV39H1 | — | H3K9me2/3 | H. sapiens | 412 | 79-412 (Snowden) | 334 | 172-412: preSET, SET, postSET |
| Suvar3-9 | dim-5 | — | H3K9me3 | N. crassa | 331 | 1-331 (Rathert) | 331 | 77-331: preSET, SET, postSET |
| Suvar3-9 (SUVH subfamily) | KYP | — | H3K9me1/2 | A. thaliana | 624 | 335-601 | 267 (Jackson) | — |
| Suvar3-9 (SUVR subfamily) | SUVR4 | H3K9me1 | H3K9me2/3 | A. thaliana | 492 | 180-492 | 313 (Thorstensen) | 192-462: preSET, SET, postSET |
| Suvar4-20 | SET4 | — | H4K20me3 | C. elegans | 288 | 1-288 (Vielle) | 288 | — |
| SET8 | SET1 | — | H4K20me1 | C. elegans | 242 | 1-242 (Vielle) | 242 | — |
| SET8 | SETD8 | — | H4K20me1 | H. sapiens | 393 | 185-393 (Couture) | 209 | 256-382: SET |
| SET8 | TgSET8 | — | H4K20me1/2/3 | T. gondii | 1893 | 1590-1893 (Sautel) | 304 | 1749-1884: SET |

In some embodiments, the functional domain may be a Histone Methyltransferase (THM/T) Recruiter Effector Domain. Preferred examples include those in the Table below, namely Hp1a, PHF19, and NIPP1.

It is also preferred to target endogenous (regulatory) control elements (such as enhancers and silencers) in addition to a promoter or promoter-proximal elements. Thus, the invention can also be used to target endogenous control

TABLE 6

Histone Methyltransferase (HMT) Recruiter Effector Domains

| Subtype/Complex | Name | Substrate (if known) | Modification (if known) | Organism | Full size (aa) | Selected truncation (aa) | Final size (aa) | Catalytic domain |
|---|---|---|---|---|---|---|---|---|
| — | Hp1a | — | H3K9me3 | M. musculus | 191 | 73-191 | 119 (Hathaway) | 121-179: chromoshadow |
| — | PHF19 | — | H3K27me3 | H. sapiens | 580 | (1-250) + GGSG linker + (500-580) | 335 (Ballaré) | 163-250: PHD2 |
| — | NIPP1 | — | H3K27me3 | H. sapiens | 351 | 1-329 (Jin) | 329 | 310-329: EED |

In some embodiments, the functional domain may be Histone Acetyltransferase Inhibitor Effector Domain. Preferred examples include SET/TAF-1β listed in the Table below.

elements (including enhancers and silencers) in addition to targeting of the promoter. These control elements can be located upstream and downstream of the transcriptional start site (TSS), starting from 200 bp from the TSS to 100 kb

TABLE 7

Histone Acetyltransferase Inhibitor Effector Domains

| Subtype/Complex | Name | Substrate (if known) | Modification (if known) | Organism | Full size (aa) | Selected truncation (aa) | Final size (aa) | Catalytic domain |
|---|---|---|---|---|---|---|---|---|
| — | SET/TAF-1β | — | — | M. musculus | 289 | 1-289 (Cervoni) | 289 | — | away. Targeting of known control elements can be used to activate or repress the gene of interest. In some cases, a single control element can influence the transcription of multiple target genes. Targeting of a single control element could therefore be used to control the transcription of multiple genes simultaneously.

Targeting of putative control elements on the other hand (e.g. by tiling the region of the putative control element as well as 200 bp up to 100 kB around the element) can be used as a means to verify such elements (by measuring the transcription of the gene of interest) or to detect novel control elements (e.g. by tiling 100 kb upstream and downstream of the TSS of the gene of interest). In addition, targeting of putative control elements can be useful in the context of understanding genetic causes of disease. Many mutations and common SNP variants associated with disease phenotypes are located outside coding regions. Targeting of such regions with either the activation or repression systems described herein can be followed by readout of transcription of either a) a set of putative targets (e.g. a set of genes located in closest proximity to the control element) or b) whole-transcriptome readout by e.g. RNAseq or microarray. This would allow for the identification of likely candidate genes involved in the disease phenotype. Such candidate genes could be useful as novel drug targets.

Histone acetyltransferase (HAT) inhibitors are mentioned herein. However, an alternative in some embodiments is for the one or more functional domains to comprise an acetyltransferase, preferably a histone acetyltransferase. These are useful in the field of epigenomics, for example in methods of interrogating the epigenome. Methods of interrogating the epigenome may include, for example, targeting epigenomic sequences. Targeting epigenomic sequences may include the guide being directed to an epigenomic target sequence. Epigenomic target sequence may include, in some embodiments, include a promoter, silencer or an enhancer sequence.

Histone modifying domains are also preferred in some embodiments. Exemplary histone modifying domains are discussed elsewhere herein. Transposase domains, HR (Homologous Recombination) machinery domains, recombinase domains, and/or integrase domains are also preferred as the present functional domains. In some embodiments, DNA integration activity includes HR machinery domains, integrase domains, recombinase domains and/or transposase domains. Histone acetyltransferases are preferred in some embodiments.

In some embodiments, the DNA cleavage activity is due to a nuclease. In some embodiments, the nuclease comprises a Fok1 nuclease. See, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided FokI Nucleases that recognize extended sequences and can edit endogenous genes with high efficiencies in human cells.

In some preferred embodiments, the functional domain is a transcriptional activation domain, such as, without limitation, VP64, p65, MyoD1, HSF1, RTA, SET7/9 or a histone acetyltransferase. In some embodiments, the functional domain is a transcription repression domain, preferably KRAB. In some embodiments, the transcription repression domain is SID, or concatemers of SID (e.g. SID4X). In some embodiments, the functional domain is an epigenetic modifying domain, such that an epigenetic modifying enzyme is provided. In some embodiments, it is advantageous that additionally at least one NLS is provided. In some instances, it is advantageous to position the NLS at the N terminus. When more than one functional domain is included, the functional domains may be the same or different. Positioning the functional domain in the RuvC domain, a Rec domain (when present), a Rec2 domain (when present), the HNH domain, or a PI domain of the Cas protein or any ortholog corresponding to these domains can be advantageous in an adaptor or accessory protein; and again, it is mentioned that the functional domain can be a DD. Positioning of the functional domains in a Rec domain or a Rec2 domain, of the Cas protein or any ortholog corresponding to these domains, in some instances may be preferred. Positioning of the functional domains in the Rec domain at position 553, Rec domain at 575, the Rec2 domain at any position of 175-306 or replacement thereof with reference to an spCas9, the HNH domain at any position of 715-901 or replacement thereof with reference to spCas9, or the PI domain at position 1153 with a reference to a SpCas9 protein or any ortholog corresponding to these domains or corresponding positions, in some instances may be preferred. Fok1 functional domain may be attached at the N terminus. When more than one functional domain is included, the functional domains may be the same or different.

The adaptor protein may be any number of proteins that binds to an aptamer or recognition site introduced into a modified nucleic acid component and which allows proper positioning of one or more functional domains, once the nucleic acid component has been incorporated into the CRISPR complex, to affect the target with the attributed function. As explained in detail in this application such may be coat proteins, preferably bacteriophage coat proteins. The functional domains associated with such adaptor proteins (e.g., in the form of fusion protein) may include, for example, one or more domains from the group consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g. light inducible). Preferred domains are Fok1, VP64, P65, HSF1, MyoD1. In the event that the functional domain is a transcription activator or transcription repressor it is advantageous that additionally at least an NLS is provided and preferably at the N terminus. When more than one functional domain is included, the functional domains may be the same or different. The adaptor protein may utilize known linkers to attach such functional domains. The adaptor protein may utilize known linkers to attach such functional domains. Such linkers may be used to associate the AAV (e.g., capsid or VP2) with the CRISPR enzyme or have the CRISPR enzyme comprise the AAV (or vice versa).

Attachment of a functional domain or fusion protein can be via a linker, e.g., a flexible glycine-serine or a rigid alpha-helical linker such as (Ala(GluAlaAlaAlaLys)Ala) (SEQ ID NO: 26). Such linkers are described elsewhere herein. Alternative linkers are available, but highly flexible linkers are thought to work best to allow for maximum opportunity for the 2 parts of the Cas to come together and thus reconstitute Cas activity. One alternative is that the NLS of nucleoplasmin can be used as a linker. For example, a linker can also be used between the Cas and any functional domain. Again, a (GGGGS)$_3$ (SEQ ID NO: 1) linker may be used here (or the 6, 9, or 12 repeat versions therefore) or the NLS of nucleoplasmin can be used as a linker between Cas and the functional domain.

Other Accessory Molecules

In some embodiments, and as described in greater detail elsewhere herein, one or more of the polypeptides of the nucleic acid targeting system described herein can be configured for expression and/or delivery via an AAV. As such one or more of the polypeptides of the nucleic acid targeting system described herein can be provided as an AAV-CRISPR enzyme. In some embodiments, one or more of the AAV-CRISPR enzyme is part of a complexed with one or more polynucleotides (e.g., nucleic acid components described herein, repair templates, etc. described herein).

In some embodiments, an AAV-CRISPR enzyme includes one or more nuclear localization sequences and/or NES (nuclear export sequences). In some embodiments, said AAV-CRISPR enzyme includes a regulatory element that drives transcription of component(s) of the CRISPR system (e.g., RNA, such as guide RNA and/or HR template nucleic acid molecule) in a eukaryotic cell such that said AAV-CRISPR enzyme delivers the CRISPR system accumulates in a detectable amount in the nucleus of the eukaryotic cell and/or is exported from the nucleus. In some embodiments, the regulatory element is a polymerase II promoter. In some embodiments, the AAV-CRISPR enzyme is a type II AAV-CRISPR system enzyme. In some embodiments, the AAV-CRISPR enzyme is an AAV-Cas enzyme. In some embodiments, the AAV-Cas enzyme is derived from S. pneumoniae, S. pyogenes, S. thermophilus, F. novicida or S. aureus Type II-D Cas (e.g., modified to have or be associated with at least one AAV), and may include further alteration or mutation of the Type II-D Cas, and can be a chimeric Type II-D Cas. In some embodiments, the AAV-CRISPR enzyme is codon-optimized for expression in a eukaryotic cell. In some embodiments, the AAV-CRISPR enzyme directs cleavage of one or two strands at the location of the target sequence. In some embodiments, the AAV-CRISPR enzyme lacks or substantially DNA strand cleavage activity (e.g., no more than 5% nuclease activity as compared with a wild type enzyme or enzyme not having the mutation or alteration that decreases nuclease activity). In some embodiments, the first regulatory element is a polymerase III promoter. In some embodiments, the second regulatory element is a polymerase II promoter. In some embodiments, the guide sequence is at least 15, 16, 17, 18, 19, 20, 25 nucleotides, or between 10-30, or between 15-25, or between 15-20 nucleotides in length.

With respect to the AAV-CRISPR enzyme described herein the CRISPR enzyme component can be a mutant (e.g., a Cas mutant as described elsewhere herein). In embodiments, when the CRISPR enzyme is not SpCas9 (e.g., is Cas (e.g., Type II-D Cas), mutations may be made at any or all residues corresponding to positions 10, 762, 840, 854, 863 and/or 986 of SpCas9 (which may be ascertained for instance by standard sequence comparison tools). In particular, any or all of the following mutations are preferred in Type II-D Cas: D10A, E762A, H840A, N854A, N863A and/or D986A; as well as conservative substitution for any of the replacement amino acids is also envisaged. Corresponding positions in Type II-D Cas will be appreciated in view of the description herein and sequence and/or protein analysis techniques generally known in the art. In some embodiments, the Type II-D AAV-CRISPR enzyme comprises at least one or more, or at least two or more mutations, wherein the at least one or more mutation is or at least two or more mutations is as to D10, E762, H840, N854, N863, or D986 according to or corresponding to SpCas9 protein, e.g., D10A, E762A, H840A, N854A, N863A and/or D986A as to SpCas9, or N580 according to SaCas9 or SaCas9-like, e.g., N580A as to SaCas9, or any corresponding mutation(s) in a Cas9 of an ortholog to Sp or Sa, or the Type II-D CRISPR enzyme comprises at least one mutation wherein at least H840 or N863A as to SpCas9 or N580A as to SaCas9 is mutated; e.g., wherein the CRISPR enzyme comprises H840A, or D10A and H840A, or D10A and N863A, according to SpCas9 protein, or any corresponding mutation(s) in a Cas9 or of an ortholog to Sp protein or Sa protein.

In an embodiment of the invention the Type II-D AAV-CRISPR enzyme comprises one or two or more mutations in a residue selected from the group comprising, consisting essentially of, or consisting of D10, E762, H840, N854, N863, or D986 with reference to an SpCas9. In a further embodiment the Type II-D AAV-CRISPR enzyme comprises one or two or more mutations selected from the group comprising D10A, E762A, H840A, N854A, N863A or D986A with reference to an SpCas9. In another embodiment, the functional domain comprises, consist essentially of a transcriptional activation domain, e.g., VP64 with reference to an SpCas9. In another embodiment, the functional domain comprises, consist essentially of a transcriptional repressor domain, e.g., KRAB domain, SID domain or a SID4X domain. In embodiments of the invention, the one or more heterologous functional domains have one or more activities selected from the group comprising, consisting essentially of, or consisting of methylase activity, demethylase activity, transcription activation activity, transcription repression activity, transcription release factor activity, histone modification activity, RNA cleavage activity and nucleic acid binding activity. In further embodiments of the invention the cell is a eukaryotic cell or a mammalian cell or a human cell. In further embodiments, the adaptor protein is selected from the group comprising, consisting essentially of, or consisting of MS2, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s, PRR1. In another embodiment, the at least one loop of the sgRNA is tetraloop and/or loop2.

Further, the AAV-CRISPR enzyme with diminished nuclease activity is most effective when the nuclease activity is inactivated (e.g., nuclease inactivation of at least 70%, at least 80%, at least 90%, at least 95%, at least 97%, or 100% as compared with the wild type enzyme; or to put in another way, a AAV-Cas enzyme or AAV-CRISPR enzyme having advantageously about 0% of the nuclease activity of the non-mutated or wild type Cas enzyme or CRISPR enzyme, or no more than about 3% or about 5% or about 10% of the nuclease activity of the non-mutated or wild type Cas enzyme or CRISPR enzyme). This is possible by introducing mutations into the RuvC and HNH nuclease domains of the SpCas protein (e.g. SpCas9 or SpCas12) and orthologs thereof. For example, utilizing mutations in a residue selected from the group comprising, consisting essentially of, or consisting of D10, E762, H840, N854, N863, or D986 and more preferably introducing one or more of the mutations selected from the group comprising, consisting essentially of, or consisting of D10A, E762A, H840A, N854A, N863A or D986A. A preferable pair of mutations is D10A with H840A, more preferable is D10A with N863A with reference to SpCas9 and orthologs thereof.

Modulators of DSB Repair Mechanisms

CRISPR-Cas systems typically evoke a double strand break repair mechanism in modifying a polynucleotide (see e.g., Yang et al., 2020. Int. J. Mol. Sci. 21:6461) In some embodiments, one or more Cas proteins of the CRISPR-Cas system is fused to, coupled to, or otherwise associated with one or more accessory molecules that can promote or inhibit/minimize one or more endogenous double strand break mechanisms of the cell (e.g., HDR (homology directed repair) and/or NHEJ (non-homologous end joining)). In some embodiments, HDR can be enhanced by minimizing NHEJ and/or stimulating HDR. See e.g., Yang et al., 2020. Int. J. Mol. Sci. 21:646, particularly at Section 4, pages 8-12 and Table 1. In some embodiments NEHJ can be reduced or minimized by fusing, coupling, or otherwise associating one or more of the Cas proteins within the CRISRP-Cas systems of the present invention described in greater detail elsewhere herein with Lambda Gam and/or other NHEJ inhibitors and/or HDR activators or active domain(s) thereof. Other NHEJ inhibitors are generally known in the art which can be suitable for use in a similar fashion to Lambda Gam in the present invention.

In some embodiments, the NHEJ inhibitor(s) and/or HDR activator(s) can be attached to the Cas protein via a linker at one or more sites on the Cas protein. Suitable attachment sites and chemistries are demonstrated in relation to Cas9 as shown in e.g., FIGS. 15A-15D and related discussion within International Patent Publication No. WO 2019135816, which show e.g. (FIG. 15A) a crystal structure showing potential sites for engineered cysteines on Cas9; (FIG. 15B) a schematic showing an example of SynGEM (left) with possible conjugation chemistries (right); (FIG. 15C) a diagram showing structures and potential linker attachment sites for known NHEJ inhibitors and HDR activator; and (FIG. 15D) a diagram showing a reported scaffold for multivalent display of NHEJ inhibitors or HDR activators on Cas9, all of which may be adapted for use with the Type II-D Cas proteins of the present invention. Homologous attachment positions in other Cas proteins can be appreciated in view of this description and can be used to attach an NHEJ inhibitor and/or HDR activator on Cas proteins other than Cas 9. The conjugation can be effected via cysteines, sortase, or using unnatural amino acids bearing tetrazine or acetylphenyl alanine. See also International Application WO 2019135816 at Working Examples 6-8. In some embodiments, the attachment site for the linker comprises or is modified to comprise an aryl ring.

In some embodiments, the DSB repair mechanism modulator(s) is/are directly attached to or coupled to via a linker to a Cas of the CRISPR-Cas system (including but not limited to a small Type II-D Cas protein or variant described in greater detail elsewhere herein). As used herein, "attached" refers to covalent or non-covalent interaction between two or more molecules. Non-covalent interactions can include ionic bonds, electrostatic interactions, van der Walls forces, dipole-dipole interactions, dipole-induced-dipole interactions, London dispersion forces, hydrogen bonding, halogen bonding, electromagnetic interactions, 7L-7L interactions, cation-7c interactions, anion-7c interactions, polar 7r-interactions, and hydrophobic effects. In some embodiments, the attachment is a covalent attachment. In some embodiments, the attachment is a non-covalent attachment. In some embodiments, the donor/insert polynucleotide can be attached via chemical linker such as any of those described in e.g., International Application Publication WO 2019135816. In some embodiments, a linker or other tether can be used to couple the donor polynucleotide to a Cas protein or other CRISPR-Cas system component. In some embodiments, attachment (direct or via a linker or other tether) occurs at one or more sites in the Cas protein, such as any of those shown in or homologous to those shown in FIG. 15A of International Application Publication WO 2019135816. In some embodiments, attachment (direct or via a linker or other tether) of the donor polynucleotide is at any one or more residues E1207, S1154, S1116, S355, E471, E1068, E945, E1026, Q674, E532, K558, S204, Q826, D435, S867 relative to a Cas9 or a homologue thereof in another Cas protein.

In some embodiments, one or more NEJH inhibitors and one or more HDR activators are attached or coupled to the same Cas protein.

In some embodiments, the linker used to couple the NHEJ inhibitor and/or HDR activator is a cleavable or biodegradable linker. In some embodiments, the linker is an inducible linker, a switchable linker, a chemical linker, a PEG linker, a functionalized inker, or a GlySar linker.

In some embodiments the linkers are non-functionalized or functionalized PEG linkers (alkyne, azide, cyclooctyne etc.) that are commercially available can be employed for conjugation of NHEJ inhibitors at the (E≥position.

International Application WO 2019135816 also describes objective tests to determine if attachment and/or incorporation of an NHEJ inhibitor and/or HDR activator is successful and can be used to determine if compositions of the present invention are effective.

Design of CRISPR-Cas Systems

In a further embodiments, the invention involves a computer-assisted method for identifying or designing potential compounds to fit within or bind to CRISPR-Cas system or a functional portion thereof or vice versa (a computer-assisted method for identifying or designing potential CRISPR-Cas systems or a functional portion thereof for binding to desired compounds) or a computer-assisted method for identifying or designing potential CRISPR-Cas systems (e.g., with regard to predicting areas of the CRISPR-Cas system to be able to be manipulated—for instance, based on crystal structure data or based on data of Cas orthologs, or with respect to where a functional group such as an activator or repressor can be attached to the CRISPR-Cas system, or as to Cas truncations or as to designing nickases), said method including:

using a computer system, e.g., a programmed computer comprising a processor, a data storage system, an input device, and an output device, the steps of:

(a) inputting into the programmed computer through said input device data comprising the three-dimensional co-ordinates of a subset of the atoms from or pertaining to the CRISPR-Cas crystal structure (e.g. a CRISPR-Cas crystal structure), e.g., in the CRISPR-Cas system binding domain or alternatively or additionally in domains that vary based on variance among Cas orthologs or as to e.g. Type II-D Cas or as to nickases or as to functional groups, optionally with structural information from CRISPR-Cas system complex(es), thereby generating a data set;

(b) comparing, using said processor, said data set to a computer database of structures stored in said computer data storage system, e.g., structures of compounds that bind or putatively bind or that are desired to bind to a CRISPR-Cas system or as to Cas orthologs (e.g., as Type II-D Cas or as to domains or regions that vary amongst Cas orthologs) or as to the CRISPR-Cas crystal structure or as to nickases or as to functional groups;

(c) selecting from said database, using computer methods, structure(s)—e.g., CRISPR-Cas structures that may bind to desired structures, desired structures that may bind to certain CRISPR-Cas structures, portions of the CRISPR-Cas system that may be manipulated, e.g., based on data from other portions of the CRISPR-Cas crystal structure and/or from Cas orthologs, truncated Cas, novel nickases or particular functional groups, or positions for attaching functional groups or functional-group-CRISPR-Cas systems;

(d) constructing, using computer methods, a model of the selected structure(s); and (e) outputting to said output device the selected structure(s);

and optionally synthesizing one or more of the selected structure(s);

and further optionally testing said synthesized selected structure(s) as or in a CRISPR-Cas system; or, said method comprising: providing the co-ordinates of at least two atoms of the CRISPR-Cas crystal structure, e.g., at least two atoms of the herein Crystal Structure Table of the CRISPR-Cas crystal structure or co-ordinates of at least a sub-domain of the CRISPR-Cas crystal structure ("selected co-ordinates"), providing the structure of a candidate comprising a binding molecule or of portions of the CRISPR-Cas system that may be manipulated, e.g., based on data from other portions of the CRISPR-Cas crystal structure and/or from Cas orthologs, or the structure of functional groups, and fitting the structure of the candidate to the selected co-ordinates, to thereby obtain product data comprising CRISPR-Cas structures that may bind to desired structures, desired structures that may bind to certain CRISPR-Cas structures, portions of the CRISPR-Cas system that may be manipulated, truncated Cas, novel nickases, or particular functional groups, or positions for attaching functional groups or functional-group-CRISPR-Cas systems, with output thereof, and optionally synthesizing compound(s) from said product data and further optionally comprising testing said synthesized compound(s) as or in a CRISPR-Cas system.

The testing can include analyzing the CRISPR-Cas system resulting from said synthesized selected structure(s), e.g., with respect to binding, or performing a desired function.

The output in the foregoing methods can comprise data transmission, e.g., transmission of information via telecommunication, telephone, video conference, mass communication, e.g., presentation such as a computer presentation (e.g. POWERPOINT), internet, email, documentary communication such as a computer program (e.g. WORD) document and the like. Accordingly, the invention also comprehends computer readable media containing: atomic co-ordinate data according to the herein-referenced Crystal Structure, said data defining the three-dimensional structure of CRISPR-Cas or at least one sub-domain thereof, or structure factor data for CRISPR-Cas, said structure factor data being derivable from the atomic co-ordinate data of herein-referenced Crystal Structure. The computer readable media can also contain any data of the foregoing methods. The invention further comprehends methods a computer system for generating or performing rational design as in the foregoing methods containing either: atomic co-ordinate data according to herein-referenced Crystal Structure, said data defining the three-dimensional structure of CRISPR-Cas or at least one sub-domain thereof, or structure factor data for CRISPR-Cas, said structure factor data being derivable from the atomic co-ordinate data of herein-referenced Crystal Structure. The invention further comprehends a method of doing business comprising providing to a user the computer system or the media or the three-dimensional structure of CRISPR-Cas or at least one sub-domain thereof, or structure factor data for CRISPR-Cas, said structure set forth in and said structure factor data being derivable from the atomic co-ordinate data of herein-referenced Crystal Structure, or the herein computer media or a herein data transmission.

A "binding site" or an "active site" comprises or consists essentially of or consists of a site (such as an atom, a functional group of an amino acid residue or a plurality of such atoms and/or groups) in a binding cavity or region, which may bind to a compound such as a nucleic acid molecule, which is/are involved in binding.

By "fitting" is meant determining by automatic, or semi-automatic means, interactions between one or more atoms of a candidate molecule and at least one atom of a structure of the invention and calculating the extent to which such interactions are stable. Interactions include attraction and repulsion, brought about by charge, steric considerations and the like. Various computer-based methods for fitting are described further.

By "root mean square (or rms) deviation", refers to the square root of the arithmetic mean of the squares of the deviations from the mean.

By a "computer system", is meant the hardware means, software means and data storage means used to analyze atomic coordinate data. The minimum hardware means of the computer-based systems of the present invention typically comprises a central processing unit (CPU), input means, output means and data storage means. Desirably a display or monitor is provided to visualize structure data. The data storage means may be RAM or means for accessing computer readable media of the invention. Examples of such systems are computer and tablet devices running Unix, Windows or Apple operating systems.

By "computer readable media", is meant any medium or media, which can be read and accessed directly or indirectly by a computer e.g., so that the media is suitable for use in the above-mentioned computer system. Such media include, but are not limited to: magnetic storage media such as floppy discs, hard disc storage medium and magnetic tape; optical storage media such as optical discs or CD-ROM; electrical storage media such as RAM and ROM; thumb drive devices; cloud storage devices and hybrids of these categories such as magnetic/optical storage media.

The invention comprehends the use of the protected guides described herein above in the optimized functional CRISPR-Cas enzyme systems described herein.

Optimizing Efficacy of the CRISPR-Cas Systems

The CRISPR-Cas systems described herein can be optimized for efficacy. Such design strategies can take into consideration, for example, the Cas effector activity, guide polynucleotide activity, and on/off target activity.

Selection of a Most Active Enzyme

Enzyme Stability

The level of expression of a protein is dependent on many factors, including the quantity of mRNA, its stability and rates of ribosome initiation. The stability or degradation of mRNA is an important factor. Several strategies have been described to increase mRNA stability. One aspect is codon-optimization. It has been found that GC-rich genes are expressed several-fold to over a 100-fold more efficiently than their GC-poor counterparts. This effect could be directly attributed to increased steady-state mRNA levels, and more particularly to efficient transcription or mRNA processing (not decreased degradation) (Kudla et al. Plos Biology http://dx.doi.org/10.1371/journal.pbio.0040180). Also, it has been found that ribosomal density has a significant effect on the transcript half-life. More particularly, it was found that an increase in stability can be achieved through the incorporation of nucleotide sequences that are capable of forming secondary structures, which often recruit ribosomes, which impede mRNA degrading enzymes. WO2011/141027 describes that slowly-read codons can be positioned in such a way as to cause high ribosome occupancy across a critical region of the 5' end of the mRNA can increase the half-life of a message by as much as 25%, and produce a similar uplift in protein production. In contrast, positioning even a single slow-read codon before this critical region can significantly destabilize the mRNA and result in an attenuation of protein expression. This understanding enables the design of mRNAs so as to suit the desired functionality. In addition, chemical modifications such as those described for guide sequences herein can be envisaged to increase mRNA stability.

Selection of a Most Active Guide

Guide Stability

Guide stability can be altered to increase or decrease the efficacy or efficiency of the CRISPR-Cas system. Chemical modification of the guide polynucleotides can alter the stability of the guide polynucleotides. The guide polynucleotides can be designed to achieve a desired stability by the incorporation of chemically modified nucleotides. In certain embodiments, the gRNA(s) incorporated in the CRISPR-Cas system can be chemically modified guide RNAs. Examples of guide RNA chemical modifications include, without limitation, incorporation of 2'-O-methyl (M), 2'-O-methyl 3'phosphorothioate (MS), or 2'-O-methyl 3'thio-PACE (MSP) at one or more terminal nucleotides. Such chemically modified guide RNAs can comprise increased stability and increased activity as compared to unmodified guide RNAs, though on-target vs. off-target specificity is not predictable. (See, Hendel, 2015, Nat Biotechnol. 33(9):985-9, doi: 10.1038/nbt.3290, published online 29 Jun. 2015). Chemically modified guide RNAs further include, without limitation, RNAs with phosphorothioate linkages and locked nucleic acid (LNA) nucleotides comprising a methylene bridge between the 2' and 4' carbons of the ribose ring.

Rahdar et al. describe methods to ensure stabilization in the tracer hybridization region (Proc Natl Acad Sci USA. 2015, 22; 112(51):E7110-7. doi: 10.1073). Such methods can be adapted for use in designing a CRISPR-Cas system described herein.

Select Best Target Site in Gene

Studies to date suggest that while sgRNA activity can be quite high, there is significant variability among sgRNAs in their ability to generate the desired target cleavage. Efforts have been made to identify design criteria to maximize guide RNA efficacy. Doench et al. (Nat Biotechnol. 2014 December; 32(12): 1262-1267 and Nat Biotechnol. PubMed PMID: 26780180) describe the development of a quantitative model to optimize sgRNA activity prediction, and a tool to use this model for sgRNA design. Accordingly, in particular embodiments, the methods provided herein can include identifying an optimal guide sequence based on a statistical comparison of active guide RNAs, such as described by Doench et al. (above). In particular embodiments, at least five gRNAs are designed per target and these are tested empirically in cells to generate at least one which has sufficiently high activity.

Identification of Suitable Guide Sequence

Currently RNA guides are designed using the reference human genome; however, failing to take into account variation in the human population may confound the therapeutic outcome for a given RNA guide. The recently released ExAC dataset, based on 60,706 individuals, contains on average one variant per eight nucleotides in the human exome (Lek, M. et al. Nature 536, 285-291 (2016)). This highlights the potential for genetic variation to impact the efficacy of certain RNA guides across patient populations for CRISPR-based gene therapy, due to the presence of mismatches between the RNA guide and variants present in the target site of specific patients. To assess this impact, the ExAC dataset was used and can be used to catalog variants present in all possible targets in the human reference exome that either (i) disrupt the target PAM sequence or (ii) introduce mismatches between the RNA guide and the genomic DNA, which can collectively be termed target variation. For treatment of a patient population, avoiding target variation for RNA guides administered to individual patients will maximize the consistency of outcomes for a genome editing therapeutic.

In some embodiments, the CRISPR-Cas system can include RNA guide(s) for platinum targets. This can, in some embodiments, achieve targeting for 99.99% of patients. In some embodiments, these RNA guides can be further selected to minimize the number of off-target candidates occurring on high frequency haplotypes in the patient population (discussed elsewhere herein). In some embodiments, low frequency variation captured in large scale sequencing datasets can be used to estimate the number of guide RNA-enzyme combinations required to effectively and safely treat different sizes of patient populations. In some embodiments, pre-therapeutic whole genome sequencing of individual patients can be completed and analyzed to select an optimal guide RNA-Cas enzyme combination for treatment of a specific patient or patient population. In some embodiments, the selected guide RNA-Cas enzyme combination can be a perfect match to the patient's genome. In some embodiments, the selected guide RNA-Cas enzyme combination can be free of patient-specific off-target candidates. This framework can also be used, in some embodiments, in combination with additional human sequencing data, which can further refine these selection criteria and can allow for the design and validation of genome editing therapeutics while minimizing both the number of guide RNA-enzyme combinations necessary for approval and the cost of delivering effective and safe gene therapies to patients.

In some embodiments, the methods provided herein comprise one or more of the following steps: (1) identifying platinum targets, (2) selection of the guides to minimize the number of off-target candidates occurring on high frequency haplotypes in the patient population; (3) select guide (and/or effector protein) based low frequency variation captured in large scale sequencing datasets to estimate the number of guide RNA-enzyme combinations required to effectively and safely treat different sizes of patient populations, and (4) confirm or select guide based on pre-therapeutic whole genome sequencing of individual patient. In particular embodiments, a "platinum" target is one that does not contain variants occurring at ≥0.01% allele frequency.

Determination of on Off-Target Activity and Selecting Suitable Target Sequences Guides In certain example embodiments, parameters such as, but not limited to, off-target candidates, PAM restrictiveness, target cleavage efficiency, or effector protein specific may be determined using sequencing-based double-strand break (DSB) detection assays. Example sequencing-based DSB detection assay sChIP-seq (Szilard et al. Nat. Struct. Mol. Biol. 18, 299-305 (2010); Iacovoni et al. EMBO J. 29, 1446-1457 (2010)), BLESS (Crosetto et al. Nat. Methods 10, 361-365 (2013); Ran et al. Nature 520, 186-191 (2015); Slaymaker et al. Science 351, 84-88 (2016)), GUIDEseq (Tsai et al. Nat. Biotech 33, 187-197 (2015)), Digenome-seq (Kim et al. Nat. Methods 12, 237-43 (2015)), IDLV-mediated DNA break capture (Wang et al. Nat. Biotechnol. 33, 175-178 (2015) nature.com/articles/nbt.3127, HTGTS (Frock et al. Nat. Biotechnol. 33, 179-186 (2015)), End-Seq (Canela et al. Mol. Cell 63, 898-911 (2016), and DSBCapture (Lensing et al. Nat. Methods 13, 855-857 (2016). Additional methods that may be used to assess target cleavage efficiency include SITE-Seq (Cameron et al. Nature Methods, 14, 600-606 (2017), and CIRCLE-seq (Tsai et al. Nature Methods 14, 607-614 (2017)).

Methods useful for assessing Cpf1 RNase activity include those disclosed in Zhong et al. Nature Chemical Biology Jun. 19, 2017 doi: 10.1038/NCHEMBIO.2410 and may be similarly applied to Cas effectors described herein (including but not limited to the Cas effectors described herein). Increased RNase activity and the ability to excise multiple CRISPR RNAs (crRNA) from a single RNA polymerase II-driven RNA transcript can simplify modification of multiple genomic targets and can be used to increase the efficiency of Cas (e.g., Type II-D Cas)-mediated editing.
BLISS Other suitable assays include those described in Yan et al. ("BLISS: quantitative and versatile genome-wide profiling of DNA breaks in situ" BioRxiv, Dec. 4, 2016 doi: http://dx.doi.org/10.1101/091629) describe a versatile, sensitive and quantitative method for detecting DSBs applicable to low-input specimens of both cells and tissues that is scalable for high-throughput DSB mapping in multiple samples. Breaks Labeling In Situ and Sequencing (BLISS), features efficient in situ DSB labeling in fixed cells or tissue sections immobilized onto a solid surface, linear amplification of tagged DSBs via T7-mediated in vitro transcription (IVT) for greater sensitivity, and accurate DSB quantification by incorporation of unique molecular identifiers (UMIs).
Curtain A further method, referred to herein as "Curtain" has been developed which may also be useful in assessing certain parameters disclosed herein, the method allowing on target and off target cutting of a nuclease to be assessed in a direct and unbiased way using in vitro cutting of immobilized nucleic acid molecules. Further reference is made to WO/2017/218979, which is. Incorporated by reference herein and can be adapted for use in the design and/or characterization of the CRISRP-Cas systems described herein.

This method may also be used to select a suitable guide RNA. The method allows the detection of a nucleic acid modification, by performing the following steps: i) contacting one or more nucleic acid molecules immobilized on a solid support (immobilized nucleic acid molecules) with an agent capable of inducing a nucleic acid modification; and ii) sequencing at least part of said one or more immobilized nucleic acid molecules that comprises the nucleic acid modification using a primer specifically binding to a primer binding site. This method further allows the selection of a guide RNA from a plurality of guide RNAs specific for a selected target sequence. In particular embodiments, the method comprises contacting a plurality of nucleic acid molecules immobilized on a solid support (immobilized nucleic acid molecules) with a plurality of RNA-guided nuclease complexes capable of inducing a nucleic acid break, said plurality of RNA-guided nuclease complexes comprising a plurality of different guide RNA's, thereby inducing one or more nucleic acid breaks; attaching an adapter comprising a primer binding site to said one or more immobilized nucleic acid molecules comprising a nucleic acid break; sequencing at least part of said one or more immobilized nucleic acid molecules comprising a nucleic acid break using a primer specifically binding to said primer binding site; and selecting a guide RNA based on location and/or amount of said one or more breaks.

In particular embodiments, the method comprises determining one or more locations in said one or more immobilized nucleic acid molecules comprising a break other than a location comprising said selected target sequence (off-target breaks) and selecting a guide RNA based on said one or more locations. In particular embodiments, step v comprises determining a number of sites in said one or more immobilized nucleic acid molecules comprising off-target breaks and selecting a guide RNA based on said number of sites. In a further embodiment, step iv comprises both determining the location of off-targets breaks and the number of locations of off-target breaks.
Optimizing Safety of the CRISPR-Cas Systems
Selection of the Cas-Effector(s) with the Shortest Half-Life
Half-Life of the Cas Effector(s)

The extended presence of an effector protein after having performed its function at the target site is a potential safety concern, both for off-target effects and direct toxicity of the effector protein. It has been reported that upon direct delivery to the cell by LNP, CRISPR effector proteins degrade rapidly within the cell (Kim et al. Genome Res. 2014 June; 24(6): 1012-1019). Where the effector protein is to be expressed from a plasmid, strategies to actively reduce the half-life of the protein can be used in the design of the CRISPR-Cas system.
Use of Destabilized Domains In certain embodiments, the methods provided herein involve the use of a Cas effector (e.g., a Cas protein) which is associated with or fused to a destabilization domain (DD). The technology relating to the use of destabilizing domains is described in detail in WO2016/106244, which is incorporated by reference herein.

Destabilizing domains (DD) are domains which can confer instability to a wide range of proteins; see, e.g., Miyazaki, J Am Chem Soc. Mar. 7, 2012; 134(9): 3942-3945, and Chung H Nature Chemical Biology Vol. 11 Sep. 2015 pp. 713-720, incorporated herein by reference. The DD can be associated with, e.g., fused to, advantageously with a linker, to a CRISPR enzyme, whereby the DD can be stabilized in the presence of a ligand and when there is the absence thereof the DD can become destabilized, whereby the CRISPR enzyme is entirely destabilized, or the DD can be stabilized in the absence of a ligand and when the ligand is present the DD can become destabilized; the DD allows the Cas effector to be regulated or controlled, thereby providing means for regulation or control of the system. For instance, when a protein of interest is expressed as a fusion with the DD tag, it is destabilized and rapidly degraded in the cell, e.g., by proteasomes. Thus, absence of stabilizing ligand leads to a DD-associated Cas effector being degraded. Peak activity of the Cas effector is relevant to reduce off-target effects and for the general safety of the system. Advantages of the DD system include that it can be dosable, orthogonal (e.g., a ligand only affects its cognate DD so two or more systems can operate independently), transportable (e.g., may work in different cell types or cell lines) and allows for temporal control.

Suitable DD-stabilizing ligand pairs are known in the art and also described in WO2016/106244. The size of Destabilization Domain varies but is typically approx.-approx. 100-300 amino acids in size. Suitable examples include ER50 and/or DHFR50. A corresponding stabilizing ligand for ER50 is, for example, 4HT or CMP8. In some embodiments, one or two DDs may be fused to the N-terminal end of the CRISPR enzyme with one or two DDs fused to the C-terminal of the CRISPR enzyme. While the DD can be provided directly at N and/or C terminal(s) of the Cas (e.g., Type II-D Cas) effector protein, they can also be fused via a linker, such as a GlySer linker, or an NLS and/or NES. A commercially available DD system is the CloneTech, ProteoTuner™ system; the stabilizing ligand is Shield1. In some embodiments, the stabilizing ligand is a 'small molecule', preferably it is cell-permeable and has a high affinity for its corresponding DD.

In some embodiments, the CRISPR enzyme is fused to Destabilization Domain (DD). In other words, the DD may be associated with the CRISPR enzyme by fusion with said CRISPR enzyme. The AAV can then, by way of nucleic acid molecule(s) deliver the stabilizing ligand (or such can be otherwise delivered) In some embodiments, the enzyme may be considered to be a modified CRISPR enzyme, wherein the CRISPR enzyme is fused to at least one destabilization domain (DD) and VP2.

Selection of the Least Immunogenic RNP

When administering an agent to a mammal, there is always the risk of an immune response to the agent and/or its delivery vehicle. Circumventing the immune response is a major challenge for most delivery vehicles. Viral vectors, which express immunogenic epitopes within the organism typically induce an immune response. Nanoparticle and lipid-based vectors to some extent address this problem. Yin et al. demonstrate a therapeutic approach combining viral delivery of the guide RNA with lipid nanoparticle-mediated delivery of the CRISPR effector protein (Nature Biotechnology 34:328-33(2016)). Zuris et al., Nat Biotechnol 2015 January; 33(1):73-80. doi: 10.1038/nbt.3081 describes cationic-lipid mediated delivery of Cas9:guideRNA nuclease complexes to cells, which can be applied to the Type II-D CRISPR-Cas systems described herein. The Cas effector proteins (e.g., Type II-D Cas effectors described herein), which can also of bacterial origin, also inherently carry the risk of eliciting an immune response. This may be addressed by humanizing the Type II-D Cas effector protein.

Introduction of Modifications in Guide RNA to Minimize Immunogenicity

Chemical modifications of RNAs have been used to avoid reactions of the innate immune system. Judge et al. (2006) demonstrated that immune stimulation by synthetic siRNA can be completely abrogated by selective incorporation of 2'-O-methyl (2'OMe) uridine or guanosine nucleosides into one strand of the siRNA duplex (Mol. Ther., 13 (2006), pp. 494-505). Cekaite et al. (J. Mol. Biol., 365 (2007), pp. 90-108) observed that replacement of only uridine bases of siRNA with either 2'-fluoro or 2'-O-methyl modified counterparts abrogated upregulation of genes involved in the regulation of the immune response. Similarly, Hendel et al. tested sgRNAs with both backbone and sugar modifications that confer nuclease stability and can reduce immunostimulatory effects (Hendel et al., Nat. Biotechnol., 33 (2015), pp. 985-989).

In some embodiments, the guide RNA can be designed so as to minimize immunogenicity using one or more of these methods and/or incorporation of one or more chemical modifications.

Identifying Optimal Dosages to Minimize Toxicity and Maximize Specificity

It is generally accepted that the dosage of CRISPR-Cas system and/or components thereof will be relevant to toxicity and specificity of the system (Pattanayak et al. Nat Biotechnol. 2013 September; 31(9): 839-843). Hsu et al. (Nat Biotechnol. 2013 September; 31(9): 827-832) demonstrated that the dosage of SpCas9 and sgRNA can be titrated to address these issues and can be applied and/or adapted for the CRISPR-Cas systems described herein. In certain example embodiments, toxicity is minimized by saturating complex with guide by either pre-forming complex, putting guide under control of a strong promoter, or via timing of delivery to ensure saturating conditions available during expression of the effector protein.

Identification of Appropriate Delivery Method/Vehicle

To increase safety, the delivery method and/or vehicle can be optimized. Delivery methods, including but not limited to, polynucleotides, vectors, virus particles, particles etc. are described in greater detail herein. Further, advantages of various delivery compositions, formulations and techniques, with respect to e.g. safety are also discussed elsewhere herein. In some embodiments, multiple delivery techniques can be mixed and utilized to achieve the appropriate effect. Further, administration route can be altered to increase safety. Various administration routes are described elsewhere herein. Delivery timing and regimen can also be modified to increase safety of the CRISPR-Cas systems described herein. Various exemplary and non-limiting delivery regimens are described elsewhere herein. One of ordinary skill in the art will appreciate appropriate delivery compositions and approaches for specific embodiments of the CRISPR-Cas system and methods of using the CRISPR-Cas system in view of this disclosure.

CRISPR-Cas System Complexes

Components of engineered CRISPR-Cas system described herein can be provided individually or complexed with one or more other components of the engineered CRISPR-Cas system. In certain embodiments, a complex can include on or more Cas proteins bound to or otherwise associated with one or more nucleic acid components, accessory molecule(s), adaptors, and/or another component described elsewhere herein. In some embodiments, a complex can include one or more Cas proteins bound to or otherwise associated with a guide polynucleotide and optionally one or more other nucleic acid components accessory molecule(s), adaptors, and/or another component described elsewhere herein. The complexes can be provided to a subject, cell, or target polynucleotide as described in greater detail elsewhere herein.

In some embodiments, the complex thus forms a ribonucleoprotein or RNP that includes one or more CRISPR-Cas effector proteins complexed with one or more guide polynucleotides. In some embodiments, the CRISPR-Cas RNP complexes can be delivered to a cell. Suitable delivery techniques and vehicles are described elsewhere herein. An important advantage is that both RNP delivery is transient, reducing off-target effects and toxicity issues. Efficient genome editing in different cell types has been observed by Kim et al. (2014, Genome Res. 24(6):1012-9), Paix et al. (2015, Genetics 204(1):47-54), Chu et al. (2016, BMC Biotechnol. 16:4), and Wang et al. (2013, Cell. 9; 153(4): 910-8).

In particular embodiments, the ribonucleoprotein is delivered by way of a polypeptide-based shuttle agent as described in WO2016161516. WO2016161516 describes efficient transduction of polypeptide cargos using synthetic peptides comprising an endosome leakage domain (ELD) operably linked to a cell penetrating domain (CPD), to a histidine-rich domain and a CPD. Similarly, these polypeptides can be used for the delivery of CRISPR-effector based RNPs in eukaryotic cells.

The (i) Cas or nucleic acid molecule(s) encoding it or (ii) crRNA can be delivered separately; and advantageously at least one or both of one of (i) and (ii), e.g., an assembled complex is delivered via a particle or nanoparticle complex. The Cas protein mRNA can be delivered prior to the guide RNA or crRNA to give time for nucleic acid-targeting effector protein to be expressed. The Cas protein mRNA might be administered 1-12 hours (preferably around 2-6 hours) prior to the administration of guide RNA or crRNA. Alternatively, the Cas protein mRNA and guide RNA or crRNA can be administered together. Advantageously, a second booster dose of guide RNA or crRNA can be administered 1-12 hours (preferably around 2-6 hours) after the initial administration of Cas protein mRNA+guide RNA. Additional administrations of Cas protein mRNA and/or guide RNA or crRNA might be useful to achieve the most efficient levels of genome modification. Other aspects of complex delivery are further discussed elsewhere herein.

Delivery

The present disclosure also provides delivery systems for introducing components of the systems and compositions described elsewhere herein (such as a small Type II-D Cas protein and/or CRISPR-Cas system) to cells, tissues, organs, or organisms. A delivery system may comprise one or more delivery vehicles and/or cargos. Exemplary delivery systems and methods include those described in paragraphs [00117] to [00278] of Feng Zhang et al., (WO2016106236A1), and pages 1241-1251 and Table 1 of Lino C A et al., Delivering CRISPR: a review of the challenges and approaches, DRUG DELIVERY, 2018, VOL. 25, NO. 1, 1234-1257, which are incorporated by reference herein in their entireties.

In some embodiments, the delivery systems may be used to introduce the components of the systems and compositions to plant cells. For example, the components may be delivered to plant using electroporation, microinjection, aerosol beam injection of plant cell protoplasts, biolistic methods, DNA particle bombardment, and/or *Agrobacterium*-mediated transformation. Examples of methods and delivery systems for plants include those described in Fu et al., Transgenic Res. 2000 February; 9(1):11-9; Klein R M, et al., Biotechnology. 1992; 24:384-6; Casas A M et al., Proc Natl Acad Sci USA. 1993 Dec. 1; 90(23): 11212-11216; and U.S. Pat. No. 5,563,055, Davey M R et al., Plant Mol Biol. 1989 September; 13(3):273-85, which are incorporated by reference herein in their entireties.

In some embodiments, the amount or concentration, timing, delivery vehicle or approach (vector vs. mRNA vs. RNP, etc.), delivery location or type (systemic vs. local or responsive or ubiquitous, etc.) can be considered and optimized for the CRISRP-Cas system or component thereof being delivered, subject, disease, etc. and/or to reduce or minimize off-target effects. Objective tests, assays, and controls to determine optimization will be readily apparent to those of ordinary skill in the art in view of the description provided herein. For example, non-human animal, plant, and/or in vitro models can be used along with deep sequencing to analyze the extent of modification.

Cargos

The delivery systems may comprise one or more cargos. The cargos may comprise one or more components of the CRISPR-Cas systems and compositions herein. A cargo may comprise one or more of the following: i) a vector or vector system (viral or non-viral) encoding one or more Cas proteins; ii) a vector or vector system (viral or non-viral) encoding one or more guide RNAs described herein, iii) mRNA of one or more Cas proteins; iv) one or more guide RNAs; v) one or more Cas proteins; vi) one or more polynucleotides encoding one or more Cas proteins; vii) one or more polynucleotides encoding one or more guide RNAs, or viii) any combination thereof. In some examples, a cargo may comprise a plasmid encoding one or more Cas protein and one or more (e.g., a plurality of) guide RNAs. In some embodiments, a cargo may comprise mRNA encoding one or more Cas proteins and one or more guide RNA.

In some embodiments, a cargo may comprise one or more Cas proteins described herein and one or more guide RNAs, e.g., in the form of ribonucleoprotein complexes (RNP). The ribonucleoprotein complexes may be delivered by methods and systems herein. In some cases, the ribonucleoprotein may be delivered by way of a polypeptide-based shuttle agent. In one example, the ribonucleoprotein may be delivered using synthetic peptides comprising an endosome leakage domain (ELD) operably linked to a cell penetrating domain (CPD), to a histidine-rich domain and a CPD, e.g., as describe in WO2016161516. RNP may also be used for delivering the compositions and systems to plant cells, e.g., as described in Wu J W, et al., Nat Biotechnol. 2015 November; 33(11):1162-4.

In some embodiments, the cargo(s) can be any of the polynucleotide(s), e.g., CRISPR-Cas System polynucleotides described herein.

Physical Delivery

In some embodiments, the cargos may be introduced to cells by physical delivery methods. Examples of physical methods include microinjection, electroporation, and hydrodynamic delivery. Both nucleic acid and proteins may be delivered using such methods. For example, Cas protein may be prepared in vitro, isolated, (refolded, purified if needed), and introduced to cells.

Microinjection

Microinjection of the cargo directly to cells can achieve high efficiency, e.g., above 90% or about 100%. In some embodiments, microinjection may be performed using a microscope and a needle (e.g., with 0.5-5.0 m in diameter) to pierce a cell membrane and deliver the cargo directly to a target site within the cell. Microinjection may be used for in vitro and ex vivo delivery.

Plasmids comprising coding sequences for Cas proteins and/or guide RNAs, mRNAs, and/or guide RNAs, may be microinjected. In some cases, microinjection may be used i) to deliver DNA directly to a cell nucleus, and/or ii) to deliver mRNA (e.g., in vitro transcribed) to a cell nucleus or cytoplasm. In certain examples, microinjection may be used to delivery sgRNA directly to the nucleus and Cas-encoding mRNA to the cytoplasm, e.g., facilitating translation and shuttling of Cas to the nucleus.

Microinjection may be used to generate genetically modified animals. For example, gene editing cargos may be injected into zygotes to allow for efficient germline modification. Such approach can yield normal embryos and full-term mouse pups harboring the desired modification(s). Microinjection can also be used to provide transiently up- or down-regulate a specific gene within the genome of a cell, e.g., using CRISPRa and CRISPRi.

Electroporation

In some embodiments, the cargos and/or delivery vehicles may be delivered by electroporation. Electroporation may use pulsed high-voltage electrical currents to transiently open nanometer-sized pores within the cellular membrane of cells suspended in buffer, allowing for components with hydrodynamic diameters of tens of nanometers to flow into the cell. In some cases, electroporation may be used on various cell types and efficiently transfer cargo into cells. Electroporation may be used for in vitro and ex vivo delivery.

Electroporation may also be used to deliver the cargo to into the nuclei of mammalian cells by applying specific voltage and reagents, e.g., by nucleofection. Such approaches include those described in Wu Y, et al. (2015). Cell Res 25:67-79; Ye L, et al. (2014). Proc Natl Acad Sci USA 111:9591-6; Choi P S, Meyerson M. (2014). Nat Commun 5:3728; Wang J, Quake S R. (2014). Proc Natl Acad Sci 111:13157-62. Electroporation may also be used to deliver the cargo in vivo, e.g., with methods described in Zuckermann M, et al. (2015). Nat Commun 6:7391.

Hydrodynamic Delivery

Hydrodynamic delivery may also be used for delivering the cargos, e.g., for in vivo delivery. In some examples, hydrodynamic delivery may be performed by rapidly pushing a large volume (8-10% body weight) solution containing the gene editing cargo into the bloodstream of a subject (e.g., an animal or human), e.g., for mice, via the tail vein. As blood is incompressible, the large bolus of liquid may result in an increase in hydrodynamic pressure that temporarily enhances permeability into endothelial and parenchymal cells, allowing for cargo not normally capable of crossing a cellular membrane to pass into cells. This approach may be used for delivering naked DNA plasmids and proteins. The delivered cargos may be enriched in liver, kidney, lung, muscle, and/or heart.

Transfection

The cargos, e.g., nucleic acids and/or polypeptides, may be introduced to cells by transfection methods for introducing nucleic acids into cells. Examples of transfection methods include calcium phosphate-mediated transfection, cationic transfection, liposome transfection, dendrimer transfection, heat shock transfection, magnetofection, lipofection, impalefection, optical transfection, proprietary agent-enhanced uptake of nucleic acid.

Transduction

The cargos, e.g., nucleic acids and/or polypeptides, can be introduced to cells by transduction by a viral or pseudoviral particle. Methods of packaging the cargos in viral particles can be accomplished using any suitable viral vector or vector systems. Such viral vector and vector systems are described in greater detail elsewhere herein. As used in this context herein "transduction" refers to the process by which foreign nucleic acids and/or proteins are introduced to a cell (prokaryote or eukaryote) by a viral or pseudo viral particle. After packaging in a viral particle or pseudo viral particle, the viral particles can be exposed to cells (e.g. in vitro, ex vivo, or in vivo) where the viral or pseudoviral particle infects the cell and delivers the cargo to the cell via transduction. Viral and pseudoviral particles can be optionally concentrated prior to exposure to target cells. In some embodiments, the virus titer of a composition containing viral and/or pseudoviral particles can be obtained and a specific titer be used to transduce cells.

Biolistics

The cargos, e.g., nucleic acids and/or polypeptides, can be introduced to cells using a biolistic method or technique. The term of art "biolistic", as used herein refers to the delivery of nucleic acids to cells by high-speed particle bombardment. In some embodiments, the cargo(s) can be attached, associated with, or otherwise coupled to particles, which than can be delivered to the cell via a gene-gun (see e.g., Liang et al. 2018. Nat. Protocol. 13:413-430; Svitashev et al. 2016. Nat. Comm. 7:13274; Ortega-Escalante et al., 2019. Plant. J. 97:661-672). In some embodiments, the particles can be gold, tungsten, palladium, rhodium, platinum, or iridium particles.

Implantable Devices

In some embodiments, the delivery system can include an implantable device that incorporates or is coated with a CRISPR-Cas system or component thereof described herein. Various implantable devices are described in the art, and include any device, graft, or other composition that can be implanted into a subject.

Delivery Vehicles

The delivery systems may comprise one or more delivery vehicles. The delivery vehicles may deliver the cargo into cells, tissues, organs, or organisms (e.g., animals or plants). The cargos may be packaged, carried, or otherwise associated with the delivery vehicles. The delivery vehicles may be selected based on the types of cargo to be delivered, and/or the delivery is in vitro and/or in vivo. Examples of delivery vehicles include vectors, viruses (e.g., virus particles), non-viral vehicles, and other delivery reagents described herein.

The delivery vehicles in accordance with the present invention may a greatest dimension (e.g., diameter) of less than 100 microns (μm). In some embodiments, the delivery vehicles have a greatest dimension of less than 10 μm. In some embodiments, the delivery vehicles may have a greatest dimension of less than 2000 nanometers (nm). In some embodiments, the delivery vehicles may have a greatest dimension of less than 1000 nanometers (nm). In some embodiments, the delivery vehicles may have a greatest dimension (e.g., diameter) of less than 900 nm, less than 800 nm, less than 700 nm, less than 600 nm, less than 500 nm, less than 400 nm, less than 300 nm, less than 200 nm, less than 150 nm, or less than 100 nm, less than 50 nm. In some embodiments, the delivery vehicles may have a greatest dimension ranging between 25 nm and 200 nm.

In some embodiments, the delivery vehicles may be or comprise particles. For example, the delivery vehicle may be or comprise nanoparticles (e.g., particles with a greatest dimension (e.g., diameter) no greater than 1000 nm. The particles may be provided in different forms, e.g., as solid particles (e.g., metal such as silver, gold, iron, titanium), non-metal, lipid-based solids, polymers), suspensions of particles, or combinations thereof. Metal, dielectric, and semiconductor particles may be prepared, as well as hybrid structures (e.g., core-shell particles).

Nanoparticles may also be used to deliver the compositions and systems to plant cells, e.g., as described in International Patent Publication No. WO 2008042156, US 20130185823, and WO2015089419. In general, a "nanoparticle" refers to any particle having a diameter of less than 1000 nm. In certain preferred embodiments, nanoparticles of the invention have a greatest dimension (e.g., diameter) of 500 nm or less. In other preferred embodiments, nanoparticles of the invention have a greatest dimension ranging between 25 nm and 200 nm. In other preferred embodiments, nanoparticles of the invention have a greatest dimension of 100 nm or less. In other preferred embodiments, nanoparticles of the invention have a greatest dimension ranging between 35 nm and 60 nm. It will be appreciated that reference made herein to particles or nanoparticles can be interchangeable, where appropriate. Nanoparticles made of semiconducting material may also be labeled quantum dots if they are small enough (typically sub 10 nm) that quantization of electronic energy levels occurs. Such nanoscale particles are used in biomedical applications as drug carriers or imaging agents and may be adapted for similar purposes in the present invention. Semi-solid and soft nanoparticles have been manufactured and are within the scope of the present invention. Nanoparticles with one half hydrophilic and the other half hydrophobic are termed Janus particles and are particularly effective for stabilizing emulsions. They can self-assemble at water/oil interfaces and act as solid surfactants.

Particle characterization (including e.g., characterizing morphology, dimension, etc.) is done using a variety of different techniques. Common techniques are electron microscopy (TEM, SEM), atomic force microscopy (AFM), dynamic light scattering (DLS), X-ray photoelectron spectroscopy (XPS), powder X-ray diffraction (XRD), Fourier transform infrared spectroscopy (FTIR), matrix-assisted laser desorption/ionization time-of-flight mass spectrometry (MALDI-TOF), ultraviolet-visible spectroscopy, dual polarization interferometry and nuclear magnetic resonance (NMR). Characterization (dimension measurements) may be made as to native particles (i.e., preloading) or after loading of the cargo (herein cargo refers to e.g., one or more components of CRISPR-Cas system e.g., CRISPR enzyme or mRNA or guide RNA, or any combination thereof, and may include additional carriers and/or excipients) to provide particles of an optimal size for delivery for any in vitro, ex vivo and/or in vivo application of the present invention. In certain preferred embodiments, particle dimension (e.g., diameter) characterization is based on measurements using dynamic laser scattering (DLS). Mention is made of U.S. Pat. Nos. 8,709,843; 6,007,845; 5,855,913; 5,985,309; 5,543,158; and the publication by James E. Dahlman and Carmen Barnes et al. Nature Nanotechnology (2014) published online 11 May 2014, doi:10.1038/nnano.2014.84, describing particles, methods of making and using them and measurements thereof.

Vectors and Vector Systems

Also provided herein are vectors that can contain one or more of the CRISPR-Cas system polynucleotides described herein. In certain embodiments, the vector can contain one or more polynucleotides encoding one or more elements of a CRISPR-Cas system described herein. The vectors can be useful in producing bacterial, fungal, yeast, plant cells, animal cells, and transgenic animals that can express one or more components of the CRISPR-Cas system described herein. Within the scope of this disclosure are vectors containing one or more of the polynucleotide sequences described herein. One or more of the polynucleotides that are part of the CRISPR-Cas system described herein can be included in a vector or vector system. The vectors and/or vector systems can be used, for example, to express one or more of the polynucleotides in a cell, such as a producer cell, to produce CRISPR-Cas system containing virus particles described elsewhere herein. Other uses for the vectors and vector systems described herein are also within the scope of this disclosure. In general, and throughout this specification, the term "vector" refers to a tool that allows or facilitates the transfer of an entity from one environment to another. In some contexts which will be appreciated by those of ordinary skill in the art, "vector" can be a term of art to refer to a nucleic acid molecule capable of transporting another nucleic acid to which it has been linked. A vector can be a replicon, such as a plasmid, phage, or cosmid, into which another DNA segment may be inserted so as to bring about the replication of the inserted segment. Generally, a vector is capable of replication when associated with the proper control elements.

Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can be composed of a nucleic acid (e.g., a polynucleotide) of the invention in a form suitable for expression of the nucleic acid in a host cell, which means that the recombinant expression vectors include one or more regulatory elements, which can be selected on the basis of the host cells to be used for expression, that is operatively-linked to the nucleic acid sequence to be expressed. Within a recombinant expression vector, "operably linked" and "operatively-linked" are used interchangeably herein and further defined elsewhere herein. In the context of a vector, the term "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). Advantageous vectors include lentiviruses and adeno-associated viruses, and types of such vectors can also be selected for targeting particular types of cells. These and other embodiments of the vectors and vector systems are described elsewhere herein.

In some embodiments, the vector can be a bicistronic vector. In some embodiments, a bicistronic vector can be used for one or more elements of the CRISPR-Cas system described herein. In some embodiments, expression of elements of the CRISPR-Cas system described herein can be driven by the CBh promoter or other ubiquitous promoter. Where the element of the CRISPR-Cas system is an RNA, its expression can be driven by a Pol III promoter, such as a U6 promoter. In some embodiments, the two are combined.

In some embodiments, a vector capable of delivering an effector protein and optionally at least one CRISPR guide RNA to a cell can be composed of or contain a minimal promoter operably linked to a polynucleotide sequence encoding the effector protein and a second minimal promoter operably linked to a polynucleotide sequence encoding at least one guide RNA, wherein the length of the vector sequence comprising the minimal promoters and polynucleotide sequences is less than 4.4 Kb. In an embodiment, the vector can be a viral vector. In certain embodiments, the viral vector is an is an adeno-associated virus (AAV) or an adenovirus vector. In another embodiment, the effector protein is a Cas protein. In a further embodiment, the CRISPR enzyme is Type II-D Cas protein.

In some embodiments, the vector capable of delivering a lentiviral vector for an effector protein and at least one CRISPR guide RNA to a cell can be composed of or contain a promoter operably linked to a polynucleotide sequence encoding Cas and a second promoter operably linked to a polynucleotide sequence encoding at least one guide RNA, wherein the polynucleotide sequences are in reverse orientation.

In one embodiment, the invention provides a vector system comprising one or more vectors. In some embodiments, the system comprises: (a) a first regulatory element operably linked to a direct repeat sequence and one or more insertion sites for inserting one or more guide sequences upor downstream (whichever applicable) of the direct repeat sequence, wherein when expressed, the one or more guide sequence(s) direct(s) sequence-specific binding of the CRISPR complex to the one or more target sequence(s) in a eukaryotic cell, wherein the CRISPR complex comprises a Cas enzyme complexed with the one or more guide sequence(s) that is hybridized to the one or more target sequence(s); and (b) a second regulatory element operably linked to an enzyme-coding sequence encoding said Cas enzyme, preferably comprising at least one nuclear localization sequence and/or at least one NES; wherein components (a) and (b) are located on the same or different vectors of the system. Where applicable, a tracr sequence may also be provided. In some embodiments, component (a) further comprises two or more guide sequences operably linked to the first regulatory element, wherein when expressed, each of the two or more guide sequences direct sequence specific binding of a Cas CRISPR complex to a different target sequence in a eukaryotic cell. In some embodiments, the CRISPR complex comprises one or more nuclear localization sequences and/or one or more NES of sufficient strength to drive accumulation of said Cas CRISPR complex in a detectable amount in or out of the nucleus of a eukaryotic cell. In some embodiments, the first regulatory element is a polymerase III promoter. In some embodiments, the second regulatory element is a polymerase II promoter. In some embodiments, each of the guide sequences is at least 16, 17, 18, 19, 20, 25 nucleotides, or between 16-30, or between 16-25, or between 16-20 nucleotides in length.

These and others are further detailed and described elsewhere herein.

Cell-Based Vector Amplification and Expression

Vectors may be introduced and propagated in a prokaryote or prokaryotic cell. In some embodiments, a prokaryote is used to amplify copies of a vector to be introduced into a eukaryotic cell or as an intermediate vector in the production of a vector to be introduced into a eukaryotic cell (e.g. amplifying a plasmid as part of a viral vector packaging system). The vectors can be viral-based or non-viral based. In some embodiments, a prokaryote is used to amplify copies of a vector and express one or more nucleic acids, such as to provide a source of one or more proteins for delivery to a host cell or host organism.

Vectors can be designed for expression of one or more elements of the CRISPR-Cas system described herein (e.g., nucleic acid transcripts, proteins, enzymes, and combinations thereof) in a suitable host cell. In some embodiments, the suitable host cell is a prokaryotic cell. Suitable host cells include, but are not limited to, bacterial cells, yeast cells, insect cells, and mammalian cells. In some embodiments, the suitable host cell is a eukaryotic cell.

In some embodiments, the suitable host cell is a suitable bacterial cell. Suitable bacterial cells include, but are not limited to, bacterial cells from the bacteria of the species *Escherichia coli*. Many suitable strains of *E. coli* are known in the art for expression of vectors. These include, but are not limited to Pir1, Stbl2, Stbl3, Stbl4, TOP10, XL1 Blue, and XL10 Gold. In some embodiments, the host cell is a suitable insect cell. Suitable insect cells include those from *Spodoptera frugiperda*. Suitable strains of *S. frugiperda* cells include, but are not limited to, Sf9 and Sf21. In some embodiments, the host cell is a suitable yeast cell. In some embodiments, the yeast cell can be from *Saccharomyces cerevisiae*. In some embodiments, the host cell is a suitable mammalian cell. Many types of mammalian cells have been developed to express vectors. Suitable mammalian cells include, but are not limited to, HEK293, Chinese Hamster Ovary Cells (CHOs), mouse myeloma cells, HeLa, U20S, A549, HT1080, CAD, P19, NIH 3T3, L929, N2a, MCF-7, Y79, SO-Rb50, HepG G2, DIKX-X11, J558L, Baby hamster kidney cells (BHK), and chicken embryo fibroblasts (CEFs). Suitable host cells are discussed further in Goeddel, GENE EXPRESSION TECHNOLOGY: METHODS IN ENZYMOLOGY 185, Academic Press, San Diego, Calif. (1990).

In some embodiments, the vector can be a yeast expression vector. Examples of vectors for expression in yeast *Saccharomyces cerevisiae* include pYepSec1 (Baldari, et al., 1987. EMBO J. 6: 229-234), pMFa (Kuijan and Herskowitz, 1982. Cell 30: 933-943), pJRY88 (Schultz et al., 1987. Gene 54: 113-123), pYES2 (Invitrogen Corporation, San Diego, Calif.), and picZ (InVitrogen Corp, San Diego, Calif.). As used herein, a "yeast expression vector" refers to a nucleic acid that contains one or more sequences encoding an RNA and/or polypeptide and may further contain any desired elements that control the expression of the nucleic acid(s), as well as any elements that enable the replication and maintenance of the expression vector inside the yeast cell. Many suitable yeast expression vectors and features thereof are known in the art; for example, various vectors and techniques are illustrated in Yeast Protocols, 2nd edition, Xiao, W., ed. (Humana Press, New York, 2007) and Buckholz, R. G. and Gleeson, M. A. (1991) Biotechnology (NY) 9(11): 1067-72. Yeast vectors can contain, without limitation, a centromeric (CEN) sequence, an autonomous replication sequence (ARS), a promoter, such as an RNA Polymerase III promoter, operably linked to a sequence or gene of interest, a terminator such as an RNA polymerase III terminator, an origin of replication, and a marker gene (e.g., auxotrophic, antibiotic, or other selectable markers). Examples of expression vectors for use in yeast may include plasmids, yeast artificial chromosomes, 2 plasmids, yeast integrative plasmids, yeast replicative plasmids, shuttle vectors, and episomal plasmids.

In some embodiments, the vector is a baculovirus vector or expression vector and can be suitable for expression of polynucleotides and/or proteins in insect cells. In some embodiments, the suitable host cell is an insect cell. Baculovirus vectors available for expression of proteins in cultured insect cells (e.g., SF9 cells) include the pAc series (Smith, et al., 1983. Mol. Cell. Biol. 3: 2156-2165) and the pVL series (Lucklow and Summers, 1989. Virology 170: 31-39). rAAV (recombinant Adeno-associated viral) vectors are preferably produced in insect cells, e.g., *Spodoptera frugiperda* Sf9 insect cells, grown in serum-free suspension culture. Serum-free insect cells can be purchased from commercial vendors, e.g., Sigma Aldrich (EX-CELL 405).

In some embodiments, the vector is a mammalian expression vector. In some embodiments, the mammalian expression vector is capable of expressing one or more polynucleotides and/or polypeptides in a mammalian cell. Examples of mammalian expression vectors include, but are not limited to, pCDM8 (Seed, 1987. Nature 329: 840) and pMT2PC (Kaufman, et al., 1987. EMBO J. 6: 187-195). The mammalian expression vector can include one or more suitable regulatory elements capable of controlling expression of the one or more polynucleotides and/or proteins in the mammalian cell. For example, commonly used promoters are derived from polyoma, adenovirus 2, cytomegalovirus, simian virus 40, and others disclosed herein and known in the art. More detail on suitable regulatory elements are described elsewhere herein.

For other suitable expression vectors and vector systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. Genes Dev. 1: 268-277), lymphoid-specific promoters (Calame and Eaton, 1988. Adv. Immunol. 43: 235-275), in particular promoters of T cell receptors (Winoto and Baltimore, 1989. EMBO J. 8: 729-733) and immunoglobulins (Baneiji, et al., 1983. Cell 33: 729-740; Queen and Baltimore, 1983. Cell 33: 741-748), neuron-specific promoters (e.g., the neurofilament promoter; Byrne and Ruddle, 1989. Proc. Natl. Acad. Sci. USA 86: 5473-5477), pancreas-specific promoters (Edlund, et al., 1985. Science 230: 912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. Science 249: 374-379) and the α-fetoprotein promoter (Campes and Tilghman, 1989. Genes Dev. 3: 537-546). With regards to these prokaryotic and eukaryotic vectors, mention is made of U.S. Pat. No. 6,750,059, the contents of which are incorporated by reference herein in their entirety. Other embodiments can utilize viral vectors, with regards to which mention is made of U.S. patent application Ser. No. 13/092, 085, the contents of which are incorporated by reference herein in their entirety. Tissue-specific regulatory elements are known in the art and in this regard, mention is made of U.S. Pat. No. 7,776,321, the contents of which are incorporated by reference herein in their entirety. In some embodiments, a regulatory element can be operably linked to one or more elements of a CRISPR-Cas system so as to drive expression of the one or more elements of the CRISPR-Cas system described herein.

In some embodiments, the vector can be a fusion vector or fusion expression vector. In some embodiments, fusion vectors add a number of amino acids to a protein encoded therein, such as to the amino terminus, carboxy terminus, or both of a recombinant protein. Such fusion vectors can serve one or more purposes, such as: (i) to increase expression of recombinant protein; (ii) to increase the solubility of the recombinant protein; and (iii) to aid in the purification of the recombinant protein by acting as a ligand in affinity purification. In some embodiments, expression of polynucleotides (such as non-coding polynucleotides) and proteins in prokaryotes can be carried out in *Escherichia coli* with vectors containing constitutive or inducible promoters directing the expression of either fusion or non-fusion polynucleotides and/or proteins. In some embodiments, the fusion expression vector can include a proteolytic cleavage site, which can be introduced at the junction of the fusion vector backbone or other fusion moiety and the recombinant polynucleotide or protein to enable separation of the recombinant polynucleotide or protein from the fusion vector backbone or other fusion moiety subsequent to purification of the fusion polynucleotide or protein. Such enzymes, and their cognate recognition sequences, include Factor Xa, thrombin and enterokinase. Example fusion expression vectors include pGEX (Pharmacia Biotech Inc; Smith and Johnson, 1988. Gene 67: 31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein. Examples of suitable inducible non-fusion *E. coli* expression vectors include pTrc (Amrann et al., (1988) Gene 69:301-315) and pET lid (Studier et al., GENE EXPRESSION TECHNOLOGY: METHODS IN ENZYMOLOGY 185, Academic Press, San Diego, Calif. (1990) 60-89).

In some embodiments, one or more vectors driving expression of one or more elements of a CRISPR-Cas system described herein are introduced into a host cell such that expression of the elements of the engineered delivery system described herein direct formation a CRISPR-Cas complex at one or more target sites. For example, a CRISPR-Cas effector protein describe herein and a nucleic acid component (e.g., a guide polynucleotide) can each be operably linked to separate regulatory elements on separate vectors. RNA(s) of different elements of CRISPR-Cas system described herein can be delivered to an animal, plant, microorganism or cell thereof to produce an animal (e.g., a mammal, reptile, avian, etc.), plant, microorganism or cell thereof that constitutively, inducibly, or conditionally expresses different elements of the CRIPSR-Cas system described herein that incorporates one or more elements of the CRISPR-Cas system described herein or contains one or more cells that incorporates and/or expresses one or more elements of the CRISPR-Cas system described herein.

In some embodiments, two or more of the elements expressed from the same or different regulatory element(s), can be combined in a single vector, with one or more additional vectors providing any components of the system not included in the first vector. CRISPR-Cas system polynucleotides that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element and oriented in the same or opposite direction. In some embodiments, a single promoter drives expression of a transcript encoding one or more CRISPR-Cas system proteins, embedded within one or more intron sequences (e.g., each in a different intron, two or more in at least one intron, or all in a single intron). In some embodiments, the CRISPR-Cas system polynucleotides can be operably linked to and expressed from the same promoter.

Cell-Free Vector and Polynucleotide Expression

In some embodiments, the polynucleotide encoding one or more features of the CRISPR-Cas system can be expressed from a vector or suitable polynucleotide in a cell-free in vitro system. In other words, the polynucleotide can be transcribed and optionally translated in vitro. In vitro transcription/translation systems and appropriate vectors are generally known in the art and commercially available. Generally, in vitro transcription and in vitro translation systems replicate the processes of RNA and protein synthesis, respectively, outside of the cellular environment. Vectors and suitable polynucleotides for in vitro transcription can include T7, SP6, T3, promoter regulatory sequences that can be recognized and acted upon by an appropriate polymerase to transcribe the polynucleotide or vector.

In vitro translation can be stand-alone (e.g., translation of a purified polyribonucleotide) or linked/coupled to transcription. In some embodiments, the cell-free (or in vitro) translation system can include extracts from rabbit reticulocytes, wheat germ, and/or E. coli. The extracts can include various macromolecular components that are needed for translation of exogenous RNA (e.g., 70S or 80S ribosomes, tRNAs, aminoacyl-tRNA, synthetases, initiation, elongation factors, termination factors, etc.). Other components can be included or added during the translation reaction, including but not limited to, amino acids, energy sources (ATP, GTP), energy regenerating systems (creatine phosphate and creatine phosphokinase (eukaryotic systems)) (phosphoenol pyruvate and pyruvate kinase for bacterial systems), and other co-factors (Mg2+, K+, etc.). As previously mentioned, in vitro translation can be based on RNA or DNA starting material. Some translation systems can utilize an RNA template as starting material (e.g. reticulocyte lysates and wheat germ extracts). Some translation systems can utilize a DNA template as a starting material (e.g., E. coli-based systems). In these systems transcription and translation are coupled and DNA is first transcribed into RNA, which is subsequently translated. Suitable standard and coupled cell-free translation systems are generally known in the art and are commercially available.

Vector Features

The vectors can include additional features that can confer one or more functionalities to the vector, the polynucleotide to be delivered, a virus particle produced there from, or polypeptide expressed thereof. Such features include, but are not limited to, regulatory elements, selectable markers, molecular identifiers (e.g., molecular barcodes), stabilizing elements, and the like. It will be appreciated by those skilled in the art that the design of the expression vector and additional features included can depend on such factors as the choice of the host cell to be transformed, the level of expression desired, etc.

Regulatory Elements

In certain embodiments, the polynucleotides and/or vectors thereof described herein (such as the CRISPR-Cas system polynucleotides of the present invention) can include one or more regulatory elements that can be operatively linked to the polynucleotide. The term "regulatory element" is intended to include promoters, enhancers, internal ribosomal entry sites (IRES), other expression control elements (e.g., transcription termination signals, such as polyadenylation signals and poly-U sequences) and cellular localization signals (e.g., nuclear localization signals). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter can direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) (see, e.g., Boshart et al, Cell, 41:521-530 (1985)), the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit β-globin (Proc. Natl. Acad. Sci. USA., Vol. 78(3), p. 1527-31, 1981).

In some embodiments, the regulatory sequence can be a regulatory sequence described in U.S. Pat. No. 7,776,321, U.S. Pat. Pub. No. 2011/0027239, and International Patent Publication No. WO 2011/028929, the contents of which are incorporated by reference herein in their entirety. In some embodiments, the vector can contain a minimal promoter. In some embodiments, the minimal promoter is the Mecp2 promoter, tRNA promoter, or U6. In a further embodiment, the minimal promoter is tissue specific. In some embodiments, the length of the vector polynucleotide the minimal promoters and polynucleotide sequences is less than 4.4 Kb.

To express a polynucleotide, the vector can include one or more transcriptional and/or translational initiation regulatory sequences, e.g. promoters, that direct the transcription of the gene and/or translation of the encoded protein in a cell. In some embodiments a constitutive promoter may be employed. Suitable constitutive promoters for mammalian cells are generally known in the art and include, but are not limited to SV40, CAG, CMV, EF-1α, β-actin, RSV, and PGK. Suitable constitutive promoters for bacterial cells, yeast cells, and fungal cells are generally known in the art, such as a T-7 promoter for bacterial expression and an alcohol dehydrogenase promoter for expression in yeast.

In some embodiments, the regulatory element can be a regulated promoter. "Regulated promoter" refers to promoters that direct gene expression not constitutively, but in a temporally- and/or spatially-regulated manner, and includes tissue-specific, tissue-preferred and inducible promoters. Regulated promoters include conditional promoters and inducible promoters. In some embodiments, conditional promoters can be employed to direct expression of a polynucleotide in a specific cell type, under certain environmental conditions, and/or during a specific state of development. Suitable tissue specific promoters can include, but are not limited to, liver specific promoters (e.g. APOA2, SERPIN A1 (hAAT), CYP3A4, and MIR122), pancreatic cell promoters (e.g. INS, IRS2, Pdx1, Alx3, Ppy), cardiac specific promoters (e.g. Myh6 (alpha MHC), MYL2 (HLC-2v), TNI3 (cTnl), NPPA (ANF), Slc8a1 (Ncx1)), central nervous system cell promoters (SYN1, GFAP, INA, NES, MOBP, MBP, TH, FOXA2 (HNF3 beta)), skin cell specific promoters (e.g. FLG, K14, TGM3), immune cell specific promoters, (e.g. ITGAM, CD43 promoter, CD14 promoter, CD45 promoter, CD68 promoter), urogenital cell specific promoters (e.g. Pbsn, Upk2, Sbp, Fer114), endothelial cell specific promoters (e.g. ENG), pluripotent and embryonic germ layer cell specific promoters (e.g. Oct4, NANOG, Synthetic Oct4, T brachyury, NES, SOX17, FOXA2, MIR122), and muscle cell specific promoter (e.g. Desmin). Other tissue and/or cell specific promoters are generally known in the art and are within the scope of this disclosure.

Inducible/conditional promoters can be positively inducible/conditional promoters (e.g. a promoter that activates transcription of the polynucleotide upon appropriate interaction with an activated activator, or an inducer (compound, environmental condition, or other stimulus) or a negative/conditional inducible promoter (e.g. a promoter that is repressed (e.g. bound by a repressor) until the repressor condition of the promotor is removed (e.g. inducer binds a repressor bound to the promoter stimulating release of the promoter by the repressor or removal of a chemical repressor from the promoter environment). The inducer can be a compound, environmental condition, or other stimulus. Thus, inducible/conditional promoters can be responsive to any suitable stimuli such as chemical, biological, or other molecular agents, temperature, light, and/or pH. Suitable inducible/conditional promoters include, but are not limited to, Tet-On, Tet-Off, Lac promoter, pBad, AlcA, LexA, Hsp70 promoter, Hsp90 promoter, pDawn, XVE/OlexA, GVG, and pOp/LhGR.

Where expression in a plant cell is desired, the components of the CRISPR-Cas system described herein are typically placed under control of a plant promoter, i.e. a promoter operable in plant cells. The use of different types of promoters is envisaged.

A constitutive plant promoter is a promoter that is able to express the open reading frame (ORF) that it controls in all or nearly all of the plant tissues during all or nearly all developmental stages of the plant (referred to as "constitutive expression"). One non-limiting example of a constitutive promoter is the cauliflower mosaic virus 35S promoter. Different promoters may direct the expression of a gene in different tissues or cell types, or at different stages of development, or in response to different environmental conditions. In particular embodiments, one or more of the CRISPR-Cas system components are expressed under the control of a constitutive promoter, such as the cauliflower mosaic virus 35S promoter issue-preferred promoters can be utilized to target enhanced expression in certain cell types within a particular plant tissue, for instance vascular cells in leaves or roots or in specific cells of the seed. Examples of particular promoters for use in the CRISPR-Cas system are found in Kawamata et al., (1997) Plant Cell Physiol 38:792-803; Yamamoto et al., (1997) Plant J 12:255-65; Hire et al, (1992) Plant Mol Biol 20:207-18, Kuster et al, (1995) Plant Mol Biol 29:759-72, and Capana et al., (1994) Plant Mol Biol 25:681-91.

Examples of promoters that are inducible and that can allow for spatiotemporal control of gene editing or gene expression may use a form of energy. The form of energy may include but is not limited to sound energy, electromagnetic radiation, chemical energy and/or thermal energy. Examples of inducible systems include tetracycline inducible promoters (Tet-On or Tet-Off), small molecule two-hybrid transcription activations systems (FKBP, ABA, etc.), or light inducible systems (Phytochrome, LOV domains, or cryptochrome), such as a Light Inducible Transcriptional Effector (LITE) that direct changes in transcriptional activity in a sequence-specific manner. The components of a light inducible system may include one or more elements of the CRISPR-Cas system described herein, a light-responsive cytochrome heterodimer (e.g. from *Arabidopsis thaliana*), and a transcriptional activation/repression domain. In some embodiments, the vector can include one or more of the inducible DNA binding proteins provided in International Patent Publication No. WO 2014/018423 and US Patent Publication Nos., 2015/0291966, 2017/0166903, 2019/0203212, which describe e.g. embodiments of inducible DNA binding proteins and methods of use and can be adapted for use with the present invention.

In some embodiments, transient or inducible expression can be achieved by including, for example, chemical-regulated promotors, i.e. whereby the application of an exogenous chemical induces gene expression. Modulation of gene expression can also be obtained by including a chemical-repressible promoter, where application of the chemical represses gene expression. Chemical-inducible promoters include, but are not limited to, the maize ln2-2 promoter, activated by benzene sulfonamide herbicide safeners (De Veylder et al., (1997) Plant Cell Physiol 38:568-77), the maize GST promoter (GST-ll-27, WO93/01294), activated by hydrophobic electrophilic compounds used as pre-emergent herbicides, and the tobacco PR-1 a promoter (Ono et al., (2004) Biosci Biotechnol Biochem 68:803-7) activated by salicylic acid. Promoters which are regulated by antibiotics, such as tetracycline-inducible and tetracycline-repressible promoters (Gatz et al., (1991) Mol Gen Genet 227: 229-37; U.S. Pat. Nos. 5,814,618 and 5,789,156) can also be used herein.

In some embodiments, the polynucleotide, vector or system thereof can include one or more elements capable of translocating and/or expressing a CRISPR-Cas polynucleotide to/in a specific cell component or organelle. Such organelles can include, but are not limited to, nucleus, ribosome, endoplasmic reticulum, Golgi apparatus, chloroplast, mitochondria, vacuole, lysosome, cytoskeleton, plasma membrane, cell wall, peroxisome, centrioles, etc. Such regulatory elements can include, but are not limited to, nuclear localization signals (examples of which are described in greater detail elsewhere herein), any such as those that are annotated in the LocSigDB database (see e.g. http://genome.unmc.edu/LocSigDB/ and Negi et al., 2015. Database. 2015: bav003; doi: 10.1093/database/bav003), nuclear export signals (e.g., LXXXLXXLXL (SEQ ID NO: 135) and others described elsewhere herein), endoplasmic reticulum localization/retention signals (e.g. KDEL (SEQ ID NO: 136), KDXX (SEQ ID NO: 137), KKXX (SEQ ID NO: 138), KXX, and others described elsewhere herein; and see e.g. Liu et al. 2007 Mol. Biol. Cell. 18(3):1073-1082 and Gorleku et al., 2011. J. Biol. Chem. 286:39573-39584), mitochondria (see e.g. Cell Reports. 22:2818-2826, particularly at FIG. 2; Doyle et al. 2013. PLoS ONE 8, e67938; Funes et al. 2002. J. Biol. Chem. 277:6051-6058; Matouschek et al. 1997. PNAS USA 85:2091-2095; Oca-Cossio et al., 2003. 165:707-720; Waltner et al., 1996. J. Biol. Chem. 271:21226-21230; Wilcox et al., 2005. PNAS USA 102: 15435-15440; Galanis et al., 1991. FEBS Lett 282:425-430, peroxisome (e.g. (S/A/C)-(K/R/H)-(L/A), SLK, (R/K)-(L/V/I)-XXXXX-(H/Q)-(L/A/F) (SEQ ID NO: 139). Suitable protein targeting motifs can also be designed or identified using any suitable database or prediction tool, including but not limited to Minimotif Miner (http:minimotifminer.org, http://mitominer.mrc-mbu.cam.ac.uk/release-4.0/embodiment.do?name=Protein %20MTS), LocDB (see above), PTSs predictor ( ), TargetP-2.0 (http://www.cbs.dtu.dk/services/TargetP/), ChloroP (http://www.cbs.dtu.dk/services/ChloroP/); NetNES (http://www.cbs.dtu.dk/services/NetNES/), Predotar (https://urgi.versailles.inra.fr/predotar/), and SignalP (http://www.cbs.dtu.dk/services/SignalP/).

Selectable Markers and Tags

One or more of the CRISPR-Cas system polynucleotides can be operably linked, fused to, or otherwise modified to include a polynucleotide that encodes or is a selectable marker or tag, which can be a polynucleotide or polypeptide. In some embodiments, the polypeptide encoding a polypeptide selectable marker can be incorporated in the CRISPR-Cas system polynucleotide such that the selectable marker polypeptide, when translated, is inserted between two amino acids between the N- and C-terminus of the CRISPR-Cas system polypeptide or at the N- and/or C-terminus of the CRISPR-Cas system polypeptide. In some embodiments, the selectable marker or tag is a polynucleotide barcode or unique molecular identifier (UMI).

It will be appreciated that the polynucleotide encoding such selectable markers or tags can be incorporated into a polynucleotide encoding one or more components of the CRISPR-Cas system described herein in an appropriate manner to allow expression of the selectable marker or tag. Such techniques and methods are described elsewhere herein and will be instantly appreciated by one of ordinary skill in the art in view of this disclosure. Many such selectable markers and tags are generally known in the art and are intended to be within the scope of this disclosure.

Suitable selectable markers and tags include, but are not limited to, affinity tags, such as chitin binding protein (CBP), maltose binding protein (MBP), glutathione-S-transferase (GST), poly(His) tag; solubilization tags such as thioredoxin (TRX) and poly(NANP), MBP, and GST; chromatography tags such as those consisting of polyanionic amino acids, such as FLAG-tag; epitope tags such as V5-tag, Myc-tag, HA-tag and NE-tag; protein tags that can allow specific enzymatic modification (such as biotinylation by biotin ligase) or chemical modification (such as reaction with FlAsH-EDT2 for fluorescence imaging), DNA and/or RNA segments that contain restriction enzyme or other enzyme cleavage sites; DNA segments that encode products that provide resistance against otherwise toxic compounds including antibiotics, such as, spectinomycin, ampicillin, kanamycin, tetracycline, Basta, neomycin phosphotransferase II (NEO), hygromycin phosphotransferase (HPT)) and the like; DNA and/or RNA segments that encode products that are otherwise lacking in the recipient cell (e.g., tRNA genes, auxotrophic markers); DNA and/or RNA segments that encode products which can be readily identified (e.g., phenotypic markers such as β-galactosidase, GUS; fluorescent proteins such as green fluorescent protein (GFP), cyan (CFP), yellow (YFP), red (RFP), luciferase, and cell surface proteins); polynucleotides that can generate one or more new primer sites for PCR (e.g., the juxtaposition of two DNA sequences not previously juxtaposed), DNA sequences not acted upon or acted upon by a restriction endonuclease or other DNA modifying enzyme, chemical, etc.; epitope tags (e.g. GFP, FLAG- and His-tags), and, DNA sequences that make a molecular barcode or unique molecular identifier (UMI), DNA sequences required for a specific modification (e.g., methylation) that allows its identification. Other suitable markers will be appreciated by those of skill in the art.

Selectable markers and tags can be operably linked to one or more components of the CRISPR-Cas system described herein via suitable linker, such as a glycine or glycine serine linkers as short as GS or GG up to (GGGGG)$_3$ (SEQ ID NO: 27) or (GGGGS)$_3$ (SEQ ID NO: 1). Other suitable linkers are described elsewhere herein.

The vector or vector system can include one or more polynucleotides encoding one or more targeting moieties. In some embodiments, the targeting moiety encoding polynucleotides can be included in the vector or vector system, such as a viral vector system, such that they are expressed within and/or on the virus particle(s) produced such that the virus particles can be targeted to specific cells, tissues, organs, etc. In some embodiments, the targeting moiety encoding polynucleotides can be included in the vector or vector system such that the CRISPR-Cas system polynucleotide(s) and/or products expressed therefrom include the targeting moiety and can be targeted to specific cells, tissues, organs, etc. In some embodiments, such as non-viral carriers, the targeting moiety can be attached to the carrier (e.g., polymer, lipid, inorganic molecule etc.) and can be capable of targeting the carrier and any attached or associated CRISPR-Cas system polynucleotide(s) to specific cells, tissues, organs, etc.

Codon Optimization of Vector Polynucleotides

As described elsewhere herein, the polynucleotide encoding one or more embodiments of the CRISPR-Cas system or component thereof (including but not limited to a Cas protein, accessory molecule, guide molecule, template, etc.) described herein can be codon optimized. In some embodiments, one or more polynucleotides contained in a vector ("vector polynucleotides") described herein that are in addition to an optionally codon optimized polynucleotide encoding embodiments of the CRISPR-Cas system described herein can be codon optimized. In general, codon optimization refers to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/ and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g., 1, 2, 3, 4, 5, 10, 15, 20, 25, 50, or more, or all codons) in a sequence encoding a DNA/RNA-targeting Cas protein corresponds to the most frequently used codon for a particular amino acid. As to codon usage in yeast, reference is made to the online Yeast Genome database available at http://www.yeastgenome.org/community/codon_usage.shtml, or Codon selection in yeast, Bennetzen and Hall, J Biol Chem. 1982 Mar. 25; 257(6):3026-31. As to codon usage in plants including algae, reference is made to Codon usage in higher plants, green algae, and cyanobacteria, Campbell and Gowri, Plant Physiol. 1990 January; 92(1): 1-11; as well as Codon usage in plant genes, Murray et al, Nucleic Acids Res. 1989 Jan. 25; 17(2):477-98; or Selection on the codon bias of chloroplast and cyanelle genes in different plant and algal lineages, Morton B R, J Mol Evol. 1998 April; 46(4):449-59. For example, SaCas9 has been codon optimized for expression in human. See e.g., WO 2014/093622 (PCT/US2013/074667) as an example of a codon optimized sequence (from knowledge in the art and this disclosure, codon optimizing coding nucleic acid molecule(s), especially as to a Cas effector protein (e.g., Type II-D Cas) is within the ambit of the skilled artisan).

The vector polynucleotide can be codon optimized for expression in a specific cell-type, tissue type, organ type, and/or subject type. In some embodiments, a codon optimized sequence is a sequence optimized for expression in a eukaryote, e.g., humans (i.e. being optimized for expression in a human or human cell), or for another eukaryote, such as another animal (e.g. a mammal or avian) as is described elsewhere herein. Such codon optimized sequences are within the ambit of the ordinary skilled artisan in view of the description herein. In some embodiments, the polynucleotide is codon optimized for a specific cell type. Such cell types can include, but are not limited to, epithelial cells (including skin cells, cells lining the gastrointestinal tract, cells lining other hollow organs), nerve cells (nerves, brain cells, spinal column cells, nerve support cells (e.g. astrocytes, glial cells, Schwann cells etc.), muscle cells (e.g. cardiac muscle, smooth muscle cells, and skeletal muscle cells), connective tissue cells (fat and other soft tissue padding cells, bone cells, tendon cells, cartilage cells), blood cells, stem cells and other progenitor cells, immune system cells, germ cells, and combinations thereof. Such codon optimized sequences are within the ambit of the ordinary skilled artisan in view of the description herein. In some embodiments, the polynucleotide is codon optimized for a specific tissue type. Such tissue types can include, but are not limited to, muscle tissue, connective tissue, connective tissue, nervous tissue, and epithelial tissue. Such codon optimized sequences are within the ambit of the ordinary skilled artisan in view of the description herein. In some embodiments, the polynucleotide is codon optimized for a specific organ. Such organs include, but are not limited to, muscles, skin, intestines, liver, spleen, brain, lungs, stomach, heart, kidneys, gallbladder, pancreas, bladder, thyroid, bone, blood vessels, blood, and combinations thereof. Such codon optimized sequences are within the ambit of the ordinary skilled artisan in view of the description herein.

In some embodiments, a vector polynucleotide is codon optimized for expression in particular cells, such as prokaryotic or eukaryotic cells. The eukaryotic cells may be those of or derived from a particular organism, such as a plant or a mammal, including but not limited to human, or non-human eukaryote or animal or mammal as discussed herein, e.g., mouse, rat, rabbit, dog, livestock, or non-human mammal or primate.

Vector Construction

The vectors described herein can be constructed using any suitable process or technique. In some embodiments, one or more suitable recombination and/or cloning methods or techniques can be used to the vector(s) described herein. Suitable recombination and/or cloning techniques and/or methods can include, but not limited to, those described in U.S. Patent Publication No. US 2004/0171156 A1. Other suitable methods and techniques are described elsewhere herein.

Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989). Any of the techniques and/or methods can be used and/or adapted for constructing an AAV or other vector described herein. nAAV vectors are discussed elsewhere herein.

In some embodiments, a vector comprises one or more insertion sites, such as a restriction endonuclease recognition sequence (also referred to as a "cloning site"). In some embodiments, one or more insertion sites (e.g., about or more than about 1, 2, 3, 4, 5, 6, 7, 8, 9, 10, or more insertion sites) are located upstream and/or downstream of one or more sequence elements of one or more vectors. When multiple different guide polynucleotides are used, a single expression construct may be used to target nucleic acid-targeting activity to multiple different, corresponding target sequences within a cell. For example, a single vector may comprise about or more than about 1, 2, 3, 4, 5, 6, 7, 8, 9, 10, 15, 20, or more guide s polynucleotides. In some embodiments, about or more than about 1, 2, 3, 4, 5, 6, 7, 8, 9, 10, or more such guide-polynucleotide-containing vectors may be provided, and optionally delivered to a cell.

Delivery vehicles, vectors, particles, nanoparticles, formulations and components thereof for expression of one or more elements of a CRISPR-Cas system described herein are as used in the foregoing documents, such as International Patent Publication No. WO 2014/093622 (PCT/US2013/074667) and are discussed in greater detail herein.

Viral Vectors

In some embodiments, the vector is a viral vector. The term of art "viral vector" and as used herein in this context refers to polynucleotide based vectors that contain one or more elements from or based upon one or more elements of a virus that can be capable of expressing and packaging a polynucleotide, such as a CRISPR-Cas system polynucleotide of the present invention, into a virus particle and producing said virus particle when used alone or with one or more other viral vectors (such as in a viral vector system). Viral vectors and systems thereof can be used for producing viral particles for delivery of and/or expression of one or more components of the CRISPR-Cas system described herein. The viral vector can be part of a viral vector system involving multiple vectors. In some embodiments, systems incorporating multiple viral vectors can increase the safety of these systems. Suitable viral vectors can include retroviral-based vectors, lentiviral-based vectors, adenoviral-based vectors, adeno associated vectors, helper-dependent adenoviral (HdAd) vectors, hybrid adenoviral vectors, herpes simplex virus-based vectors, poxvirus-based vectors, and Epstein-Barr virus-based vectors. Other embodiments of viral vectors and viral particles produce therefrom are described elsewhere herein. In some embodiments, the viral vectors are configured to produce replication incompetent viral particles for improved safety of these systems.

In certain embodiments, the virus structural component, which can be encoded by one or more polynucleotides in a viral vector or vector system, comprises one or more capsid proteins including an entire capsid. In certain embodiments, such as wherein a viral capsid comprises multiple copies of different proteins, the delivery system can provide one or more of the same protein or a mixture of such proteins. For example, AAV comprises 3 capsid proteins, VP1, VP2, and VP3, thus delivery systems of the invention can comprise one or more of VP1, and/or one or more of VP2, and/or one or more of VP3. Accordingly, the present invention is applicable to a virus within the family Adenoviridae, such as Atadenovirus, e.g., Ovine atadenovirus D, Aviadenovirus, e.g., Fowl aviadenovirus A, Ichtadenovirus, e.g., Sturgeon ichtadenovirus A, Mastadenovirus (which includes adenoviruses such as all human adenoviruses), e.g., Human mastadenovirus C, and Siadenovirus, e.g., Frog siadenovirus A. Thus, a virus of within the family Adenoviridae is contemplated as within the invention with discussion herein as to adenovirus applicable to other family members. Target-specific AAV capsid variants can be used or selected. Non-limiting examples include capsid variants selected to bind to chronic myelogenous leukemia cells, human CD34 PBPC cells, breast cancer cells, cells of lung, heart, dermal fibroblasts, melanoma cells, stem cell, glioblastoma cells, coronary artery endothelial cells and keratinocytes. See, e.g., Buning et al, 2015, Current Opinion in Pharmacology 24, 94-104. From teachings herein and knowledge in the art as to modifications of adenovirus (see, e.g., U.S. Pat. Nos. 9,410,129, 7,344,872, 7,256,036, 6,911,199, 6,740,525; Matthews, "Capsid-Incorporation of Antigens into Adenovirus Capsid Proteins for a Vaccine Approach," Mol Pharm, 8(1): 3-11 (2011)), as well as regarding modifications of AAV, the skilled person can readily obtain a modified adenovirus that has a large payload protein or a CRISPR-protein, despite that heretofore it was not expected that such a large protein could be provided on an adenovirus. And as to the viruses related to adenovirus mentioned herein, as well as to the viruses related to AAV mentioned elsewhere herein, the teachings herein as to modifying adenovirus and AAV, respectively, can be applied to those viruses without undue experimentation from this disclosure and the knowledge in the art.

In some embodiments, the viral vector is configured such that when the cargo is packaged the cargo(s) (e.g., one or more components of the CRISPR-Cas system, including but not limited to a Cas effector, is external to the capsid or virus particle. In the sense that it is not inside the capsid (enveloped or encompassed with the capsid) but is externally exposed so that it can contact the target genomic DNA. In some embodiments, the viral vector is configured such that all the cargo(s) are contained within the capsid after packaging.

Split Viral Vector Systems

When the CRISPR-Cas system viral vector or vector system (be it a retroviral (e.g., AAV) or lentiviral vector) is designed so as to position the cargo(s) (e.g., one or more CRISPR-Cas system components) at the internal surface of the capsid once formed, the cargo(s) will fill most or all of internal volume of the capsid. In other embodiments, the CRISPR protein may be modified or divided so as to occupy a less of the capsid internal volume. Accordingly, in certain embodiments, the CRISPR-Cas system or component thereof (e.g., a Cas effector protein) can be divided in two portions, one portion comprises in one viral particle or capsid and the second portion comprised in a second viral particle or capsid. In certain embodiments, by splitting the CRISPR-Cas system or component thereof in two portions, space is made available to link one or more heterologous domains to one or both CRISPR-Cas system component (e.g., Cas protein) portions. Such systems can be referred to as "split vector systems" or in the context of the present disclosure a "split CRISPR-Cas system" a "split CRISPR protein", a "split Cas protein" and the like. This split protein approach is also described elsewhere herein. When the concept is applied to a vector system, it thus describes putting pieces of the split proteins on different vectors thus reducing the payload of any one vector. This approach can facilitate delivery of systems where the total system size is close to or exceeds the packaging capacity of the vector. This is independent of any regulation of the CRISPR-Cas system that can be achieved with a split system or split protein design.

Split CRISPR proteins that can be incorporated into the AAV or other vectors described herein are set forth elsewhere herein and in documents incorporated herein by reference in further detail herein. In certain embodiments, each part of a split CRISPR proteins are attached to a member of a specific binding pair, and when bound with each other, the members of the specific binding pair maintain the parts of the CRISPR protein in proximity. In certain embodiments, each part of a split CRISPR protein is associated with an inducible binding pair. An inducible binding pair is one which is capable of being switched "on" or "off" by a protein or small molecule that binds to both members of the inducible binding pair. In general, according to the invention, CRISPR proteins may preferably split between domains, leaving domains intact. Preferred, non-limiting examples of such CRISPR proteins include, without limitation, Cas protein, and orthologues. Preferred, non-limiting examples of split points include, with reference to SpCas9: a split position between 202A/2035; a split position between 255F/256D; a split position between 310E/311I; a split position between 534R/535K; a split position between 572E/573C; a split position between 7135/714G; a split position between 1003L/104E; a split position between 1054G/1055E; a split position between 1114N/11155; a split position between 1152K/11535; a split position between 1245K/1246G; or a split between 1098 and 1099. Corresponding positions in other Cas proteins, such as the Type II-D Cas proteins of the present invention, can be appreciated in view of these positions made with reference to SpCas9.

In some embodiments, any AAV serotype is preferred. In some embodiments, the VP2 domain associated with the CRISPR enzyme is an AAV serotype 2 VP2 domain. In some embodiments, the VP2 domain associated with the CRISPR enzyme is an AAV serotype 8 VP2 domain. The serotype can be a mixed serotype as is known in the art.

Retroviral and Lentiviral Vectors

Retroviral vectors can be composed of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Suitable retroviral vectors for the CRISPR-Cas systems can include those based upon murine leukemia virus (MuLV), gibbon ape leukemia virus (GaLV), Simian immunodeficiency virus (SIV), human immunodeficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700). Selection of a retroviral gene transfer system may therefore depend on the target tissue.

The tropism of a retrovirus can be altered by incorporating foreign envelope proteins, expanding the potential target population of target cells. Lentiviral vectors are retroviral vectors that are able to transduce or infect non-dividing cells and are described in greater detail elsewhere herein. A retrovirus can also be engineered to allow for conditional expression of the inserted transgene, such that only certain cell types are infected by the lentivirus.

Lentiviruses are complex retroviruses that have the ability to infect and express their genes in both mitotic and post-mitotic cells. Advantages of using a lentiviral approach can include the ability to transduce or infect non-dividing cells and their ability to typically produce high viral titers, which can increase efficiency or efficacy of production and delivery. Suitable lentiviral vectors include, but are not limited to, human immunodeficiency virus (HIV)-based lentiviral vectors, feline immunodeficiency virus (FIV)-based lentiviral vectors, simian immunodeficiency virus (SIV)-based lentiviral vectors, Moloney Murine Leukaemia Virus (Mo-MLV), Visna.maedi virus (VMV)-based lentiviral vector, caprine arthritis-encephalitis virus (CAEV)-based lentiviral vector, bovine immune deficiency virus (BIV)-based lentiviral vector, and Equine infectious anemia (EIAV)-based lentiviral vector. In some embodiments, an HIV-based lentiviral vector system can be used. In some embodiments, a FIV-based lentiviral vector system can be used.

In some embodiments, the lentiviral vector is an EIAV-based lentiviral vector or vector system. EIAV vectors have been used to mediate expression, packaging, and/or delivery in other contexts, such as for ocular gene therapy (see, e.g., Balagaan, J Gene Med 2006; 8: 275-285). In another embodiment, RetinoStat®, (see, e.g., Binley et al., HUMAN GENE THERAPY 23:980-991 (September 2012)), which describes RetinoStat®, an equine infectious anemia virus-based lentiviral gene therapy vector that expresses angiostatic proteins endostatin and angiostatin that is delivered via a subretinal injection for the treatment of the wet form of age-related macular degeneration. Any of these vectors described in these publications can be modified for the elements of the CRISPR-Cas system described herein.

In some embodiments, the lentiviral vector or vector system thereof can be a first-generation lentiviral vector or vector system thereof. First-generation lentiviral vectors can contain a large portion of the lentivirus genome, including the gag and pol genes, other additional viral proteins (e.g., VSV-G) and other accessory genes (e.g., vif, vprm vpu, nef, and combinations thereof), regulatory genes (e.g., tat and/or rev) as well as the gene of interest between the LTRs. First generation lentiviral vectors can result in the production of virus particles that can be capable of replication in vivo, which may not be appropriate for some instances or applications.

In some embodiments, the lentiviral vector or vector system thereof can be a second-generation lentiviral vector or vector system thereof. Second-generation lentiviral vectors do not contain one or more accessory virulence factors and do not contain all components necessary for virus particle production on the same lentiviral vector. This can result in the production of a replication-incompetent virus particle and thus increase the safety of these systems over first-generation lentiviral vectors. In some embodiments, the second-generation vector lacks one or more accessory virulence factors (e.g., vif, vprm, vpu, nef, and combinations thereof). Unlike the first-generation lentiviral vectors, no single second generation lentiviral vector includes all features necessary to express and package a polynucleotide into a virus particle. In some embodiments, the envelope and packaging components are split between two different vectors with the gag, pol, rev, and tat genes being contained on one vector and the envelope protein (e.g., VSV-G) are contained on a second vector. The gene of interest, its promoter, and LTRs can be included on a third vector that can be used in conjunction with the other two vectors (packaging and envelope vectors) to generate a replication-incompetent virus particle.

In some embodiments, the lentiviral vector or vector system thereof can be a third-generation lentiviral vector or vector system thereof. Third-generation lentiviral vectors and vector systems thereof have increased safety over first- and second-generation lentiviral vectors and systems thereof because, for example, the various components of the viral genome are split between two or more different vectors but used together in vitro to make virus particles, they can lack the tat gene (when a constitutively active promoter is included up-stream of the LTRs), and they can include one or more deletions in the 3'LTR to create self-inactivating (SIN) vectors having disrupted promoter/enhancer activity of the LTR. In some embodiments, a third-generation lentiviral vector system can include (i) a vector plasmid that contains the polynucleotide of interest and upstream promoter that are flanked by the 5' and 3' LTRs, which can optionally include one or more deletions present in one or both of the LTRs to render the vector self-inactivating; (ii) a "packaging vector(s)" that can contain one or more genes involved in packaging a polynucleotide into a virus particle that is produced by the system (e.g. gag, pol, and rev) and upstream regulatory sequences (e.g. promoter(s)) to drive expression of the features present on the packaging vector, and (iii) an "envelope vector" that contains one or more envelope protein genes and upstream promoters. In certain embodiments, the third-generation lentiviral vector system can include at least two packaging vectors, with the gag-pol being present on a different vector than the rev gene.

In some embodiments, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36 ra43) can be used/ and or adapted to the CRISPR-Cas system of the present invention.

In some embodiments, the pseudotype and infectivity or tropisim of a lentivirus particle can be tuned by altering the type of envelope protein(s) included in the lentiviral vector or system thereof. As used herein, an "envelope protein" or "outer protein" means a protein exposed at the surface of a viral particle that is not a capsid protein. For example, envelope or outer proteins typically comprise proteins embedded in the envelope of the virus. In some embodiments, a lentiviral vector or vector system thereof can include a VSV-G envelope protein. VSV-G mediates viral attachment to an LDL receptor (LDLR) or an LDLR family member present on a host cell, which triggers endocytosis of the viral particle by the host cell. Because LDLR is expressed by a wide variety of cells, viral particles expressing the VSV-G envelope protein can infect or transduce a wide variety of cell types. Other suitable envelope proteins can be incorporated based on the host cell that a user desires to be infected by a virus particle produced from a lentiviral vector or system thereof described herein and can include, but are not limited to, feline endogenous virus envelope protein (RD 114) (see e.g., Hanawa et al. Molec. Ther. 2002 5(3) 242-251), modified Sindbis virus envelope proteins (see e.g., Morizono et al. 2010. J. Virol. 84(14) 6923-6934; Morizono et al. 2001. J. Virol. 75:8016-8020; Morizono et al. 2009. J. Gene Med. 11:549-558; Morizono et al. 2006 Virology 355:71-81; Morizono et al J. Gene Med. 11:655-663, Morizono et al. 2005 Nat. Med. 11:346-352), baboon retroviral envelope protein (see e.g., Girard-Gagnepain et al. 2014. Blood. 124: 1221-1231); Tupaia paramyxovirus glycoproteins (see e.g., Enkrich T. et al., 2013. Gene Ther. 20:16-23); measles virus glycoproteins (see e.g., Funke et al. 2008. Molec. Ther. 16(8): 1427-1436), rabies virus envelope proteins, MLV envelope proteins, Ebola envelope proteins, baculovirus envelope proteins, filovirus envelope proteins, hepatitis E1 and E2 envelope proteins, gp41 and gp120 of HIV, hemagglutinin, neuraminidase, M2 proteins of influenza virus, and combinations thereof.

In some embodiments, the tropism of the resulting lentiviral particle can be tuned by incorporating cell targeting peptides into a lentiviral vector such that the cell targeting peptides are expressed on the surface of the resulting lentiviral particle. In some embodiments, a lentiviral vector can contain an envelope protein that is fused to a cell targeting protein (see e.g., Buchholz et al. 2015. Trends Biotechnol. 33:777-790; Bender et al. 2016. PLoS Pathog. 12(e1005461); and Friedrich et al. 2013. Mol. Ther. 2013. 21: 849-859.

In some embodiments, a split-intein-mediated approach to target lentiviral particles to a specific cell type can be used (see e.g., Chamoun-Emaneulli et al. 2015. Biotechnol. Bioeng. 112:2611-2617, Ramirez et al. 2013. Protein. Eng. Des. Sel. 26:215-233. In these embodiments, a lentiviral vector can contain one half of a splicing-deficient variant of the naturally split intein from *Nostoc punctiforme* fused to a cell targeting peptide and the same or different lentiviral vector can contain the other half of the split intein fused to an envelope protein, such as a binding-deficient, fusion-competent virus envelope protein. This can result in production of a virus particle from the lentiviral vector or vector system that includes a split intein that can function as a molecular Velcro linker to link the cell-binding protein to the pseudotyped lentivirus particle. This approach can be advantageous for use where surface-incompatibilities can restrict the use of, e.g., cell targeting peptides.

In some embodiments, a covalent-bond-forming protein-peptide pair can be incorporated into one or more of the lentiviral vectors described herein to conjugate a cell targeting peptide to the virus particle (see e.g., Kasaraneni et al. 2018. Sci. Reports (8) No. 10990). In some embodiments, a lentiviral vector can include an N-terminal PDZ domain of InaD protein (PDZ1) and its pentapeptide ligand (TEFCA) (SEQ ID NO: 140) from NorpA, which can conjugate the cell targeting peptide to the virus particle via a covalent bond (e.g., a disulfide bond). In some embodiments, the PDZ1 protein can be fused to an envelope protein, which can optionally be binding deficient and/or fusion competent virus envelope protein and included in a lentiviral vector. In some embodiments, the TEFCA (SEQ ID NO: 140) can be fused to a cell targeting peptide and the TEFCA-CPT fusion construct can be incorporated into the same or a different lentiviral vector as the PDZ1-envenlope protein construct. During virus production, specific interaction between the PDZ1 and TEFCA (SEQ ID NO: 140) facilitates producing virus particles covalently functionalized with the cell targeting peptide and thus capable of targeting a specific cell-type based upon a specific interaction between the cell targeting peptide and cells expressing its binding partner. This approach can be advantageous for use where surface-incompatibilities can restrict the use of, e.g., cell targeting peptides.

Lentiviral vectors have been disclosed as in the treatment for Parkinson's Disease, see, e.g., US Patent Publication No. 20120295960 and U.S. Pat. Nos. 7,303,910 and 7,351,585. Lentiviral vectors have also been disclosed for the treatment of ocular diseases, see e.g., US Patent Publication Nos. 20060281180, 20090007284, US20110117189; US20090017543; US20070054961, US20100317109. Lentiviral vectors have also been disclosed for delivery to the brain, see, e.g., US Patent Publication Nos. US20110293571; US20110293571; US20040013648, US20070025970, US20090111106 and U.S. Pat. No. 7,259,015. Any of these systems or a variant thereof can be used to deliver an CRISPR-Cas system polynucleotide described herein to a cell.

In some embodiments, a lentiviral vector system can include one or more transfer plasmids. Transfer plasmids can be generated from various other vector backbones and can include one or more features that can work with other retroviral and/or lentiviral vectors in the system that can, for example, improve safety of the vector and/or vector system, increase virial titers, and/or increase or otherwise enhance expression of the desired insert to be expressed and/or packaged into the viral particle. Suitable features that can be included in a transfer plasmid can include, but are not limited to, 5'LTR, 3'LTR, SIN/LTR, origin of replication (Ori), selectable marker genes (e.g., antibiotic resistance genes), Psi (Ψ), RRE (rev response element), cPPT (central polypurine tract), promoters, WPRE (woodchuck hepatitis post-transcriptional regulatory element), SV40 polyadenylation signal, pUC origin, SV40 origin, F1 origin, and combinations thereof.

In another embodiment, Cocal vesiculovirus envelope pseudotyped retroviral or lentiviral vector particles are contemplated (see, e.g., US Patent Publication No. 20120164118 assigned to the Fred Hutchinson Cancer Research Center). Cocal virus is in the Vesiculovirus genus and is a causative agent of vesicular stomatitis in mammals. Cocal virus was originally isolated from mites in Trinidad (Jonkers et al., Am. J. Vet. Res. 25:236-242 (1964)), and infections have been identified in Trinidad, Brazil, and Argentina from insects, cattle, and horses. Many of the vesiculoviruses that infect mammals have been isolated from naturally infected arthropods, suggesting that they are vector-borne. Antibodies to vesiculoviruses are common among people living in rural areas where the viruses are endemic and laboratory-acquired; infections in humans usually result in influenza-like symptoms. The Cocal virus envelope glycoprotein shares 71.5% identity at the amino acid level with VSV-G Indiana, and phylogenetic comparison of the envelope gene of vesiculoviruses shows that Cocal virus is serologically distinct from, but most closely related to, VSV-G Indiana strains among the vesiculoviruses. Jonkers et al., Am. J. Vet. Res. 25:236-242 (1964) and Travassos da Rosa et al., Am. J. Tropical Med. & Hygiene 33:999-1006 (1984). The Cocal vesiculovirus envelope pseudotyped retroviral vector particles may include for example, lentiviral, alpharetroviral, betaretroviral, gammaretroviral, deltaretroviral, and epsilonretroviral vector particles that may comprise retroviral Gag, Pol, and/or one or more accessory protein(s) and a Cocal vesiculovirus envelope protein. In certain embodiments of these embodiments, the Gag, Pol, and accessory proteins are lentiviral and/or gammaretroviral. In some embodiments, a retroviral vector can contain encoding polypeptides for one or more Cocal vesiculovirus envelope proteins such that the resulting viral or pseudoviral particles are Cocal vesiculovirus envelope pseudotyped.

Adenoviral Vectors, Helper-Dependent Adenoviral Vectors, and Hybrid Adenoviral Vectors In some embodiments, the vector can be an adenoviral vector. In some embodiments, the adenoviral vector can include elements such that the virus particle produced using the vector or system thereof can be serotype 2 or serotype 5.

In some embodiments, the polynucleotide to be delivered via the adenoviral particle can be up to about 8 kb. Thus, in some embodiments, an adenoviral vector can include a DNA polynucleotide to be delivered that can range in size from about 0.001 kb to about 8 kb. Adenoviral vectors have been used successfully in several contexts (see e.g., Teramato et al. 2000. Lancet. 355:1911-1912; Lai et al. 2002. DNA Cell. Biol. 21:895-913; Flotte et al., 1996. Hum. Gene. Ther. 7:1145-1159; and Kay et al. 2000. Nat. Genet. 24:257-261.

In some embodiments, the vector can be a helper-dependent adenoviral vector or system thereof. These are also referred to in the art as "gutless" or "gutted" vectors and are a modified generation of adenoviral vectors (see e.g., Thrasher et al. 2006. Nature. 443:E5-7). In certain embodiments of the helper-dependent adenoviral vector system one vector (the helper) can contain all the viral genes required for replication but contains a conditional gene defect in the packaging domain. The second vector of the system can contain only the ends of the viral genome, one or more CRISPR-Cas polynucleotides, and the native packaging recognition signal, which can allow selective packaged release from the cells (see e.g., Cideciyan et al. 2009. N Engl J Med. 361:725-727). Helper-dependent adenoviral vector systems have been successful for gene delivery in several contexts (see e.g., Simonelli et al. 2010. J Am Soc Gene Ther. 18:643-650; Cideciyan et al. 2009. N Engl J Med. 361:725-727; Crane et al. 2012. Gene Ther. 19(4):443-452; Alba et al. 2005. Gene Ther. 12:18-S27; Croyle et al. 2005. Gene Ther. 12:579-587; Amalfitano et al. 1998. J. Virol. 72:926-933; and Morral et al. 1999. PNAS. 96:12816-12821). The techniques and vectors described in these publications can be adapted for inclusion and delivery of the CRISPR-Cas system polynucleotides described herein. In some embodiments, the polynucleotide to be delivered via the viral particle produced from a helper-dependent adenoviral vector or system thereof can be up to about 37 kb. Thus, in some embodiments, an adenoviral vector can include a DNA polynucleotide to be delivered that can range in size from about 0.001 kb to about 37 kb (see e.g., Rosewell et al. 2011. J. Genet. Syndr. Gene Ther. Suppl. 5:001).

In some embodiments, the vector is a hybrid-adenoviral vector or system thereof. Hybrid adenoviral vectors are composed of the high transduction efficiency of a gene-deleted adenoviral vector and the long-term genome-integrating potential of adeno-associated, retroviruses, lentivirus, and transposon based-gene transfer. In some embodiments, such hybrid vector systems can result in stable transduction and limited integration site. See e.g., Balague et al. 2000. Blood. 95:820-828; Morral et al. 1998. Hum. Gene Ther. 9:2709-2716; Kubo and Mitani. 2003. J. Virol. 77(5): 2964-2971; Zhang et al. 2013. PloS One. 8(10) e76771; and Cooney et al. 2015. Mol. Ther. 23(4):667-674), whose techniques and vectors described therein can be modified and adapted for use in the CRISPR-Cas system of the present invention. In some embodiments, a hybrid-adenoviral vector can include one or more features of a retrovirus and/or an adeno-associated virus. In some embodiments the hybrid-adenoviral vector can include one or more features of a spuma retrovirus or foamy virus (FV). See e.g., Ehrhardt et al. 2007. Mol. Ther. 15:146-156 and Liu et al. 2007. Mol. Ther. 15:1834-1841, whose techniques and vectors described therein can be modified and adapted for use in the CRISPR-Cas system of the present invention. Advantages of using one or more features from the FVs in the hybrid-adenoviral vector or system thereof can include the ability of the viral particles produced therefrom to infect a broad range of cells, a large packaging capacity as compared to other retroviruses, and the ability to persist in quiescent (non-dividing) cells. See also e.g., Ehrhardt et al. 2007. Mol. Ther. 156:146-156 and Shuji et al. 2011. Mol. Ther. 19:76-82, whose techniques and vectors described therein can be modified and adapted for use in the CRISPR-Cas system of the present invention.

Adeno Associated Viral (AAV) Vectors

In an embodiment, the vector can be an adeno-associated virus (AAV) vector. See, e.g., West et al., Virology 160:38-47 (1987); U.S. Pat. No. 4,797,368; WO 93/24641; Kotin, Human Gene Therapy 5:793-801 (1994); and Muzyczka, J. Clin. Invest. 94:1351 (1994). Although similar to adenoviral vectors in some of their features, AAVs have some deficiency in their replication and/or pathogenicity and thus can be safer that adenoviral vectors. In some embodiments the AAV can integrate into a specific site on chromosome 19 of a human cell with no observable side effects. In some embodiments, the capacity of the AAV vector, system thereof, and/or AAV particles can be up to about 4.7 kb. In some embodiments, utilizing homologs of the Cas effector protein that are shorter can be utilized, such for example those in Table 8.

TABLE 8

Exemplary shorter Cas effector homologs.

| Species | Cas9 Size (nt) |
|---|---|
| Corynebacter diphtheriae | 3252 |
| Eubacterium ventriosum | 3321 |
| Streptococcus pasteurianus | 3390 |
| Lactobacillus farciminis | 3378 |
| Sphaerochaeta globus | 3537 |
| Azospirillum B510 | 3504 |
| Gluconacetobacter diazotrophicus | 3150 |
| Neisseria cinerea | 3246 |
| Roseburia intestinalis | 3420 |
| Parvibaculum lavamentivorans | 3111 |
| Staphylococcus aureus | 3159 |
| Nitratifractor salsuginis DSM 16511 | 3396 |
| Campylobacter lari CF89-12 | 3009 |
| Campylobacter jejuni | 2952 |
| Streptococcus thermophilus LMD-9 | 3396 |

The AAV vector or system thereof can include one or more regulatory molecules. In some embodiments the regulatory molecules can be promoters, enhancers, repressors and the like, which are described in greater detail elsewhere herein. In some embodiments, the AAV vector or system thereof can include one or more polynucleotides that can encode one or more regulatory proteins. In some embodiments, the one or more regulatory proteins can be selected from Rep78, Rep68, Rep52, Rep40, variants thereof, and combinations thereof.

The AAV vector or system thereof can include one or more polynucleotides that can encode one or more capsid proteins. The capsid proteins can be selected from VP1, VP2, VP3, and combinations thereof. The capsid proteins can be capable of assembling into a protein shell of the AAV virus particle. In some embodiments, the AAV capsid can contain 60 capsid proteins. In some embodiments, the ratio of VP1:VP2:VP3 in a capsid can be about 1:1:10.

In some embodiments, the AAV vector or system thereof can include one or more adenovirus helper factors or polynucleotides that can encode one or more adenovirus helper factors. Such adenovirus helper factors can include, but are not limited, E1A, E1B, E2A, E40RF6, and VA RNAs. In some embodiments, a producing host cell line expresses one or more of the adenovirus helper factors.

The AAV vector or system thereof can be configured to produce AAV particles having a specific serotype. In some embodiments, the serotype can be AAV-1, AAV-2, AAV-3, AAV-4, AAV-5, AAV-6, AAV-8, AAV-9 or any combinations thereof. In some embodiments, the AAV can be AAV1, AAV-2, AAV-5 or any combination thereof. One can select the AAV of the AAV with regard to the cells to be targeted; e.g., one can select AAV serotypes 1, 2, 5 or a hybrid capsid AAV-1, AAV-2, AAV-5 or any combination thereof for targeting brain and/or neuronal cells; and one can select AAV-4 for targeting cardiac tissue; and one can select AAV8 for delivery to the liver. Thus, in some embodiments, an AAV vector or system thereof capable of producing AAV particles capable of targeting the brain and/or neuronal cells can be configured to generate AAV particles having serotypes 1, 2, 5 or a hybrid capsid AAV-1, AAV-2, AAV-5 or any combination thereof. In some embodiments, an AAV vector or system thereof capable of producing AAV particles capable of targeting cardiac tissue can be configured to generate an AAV particle having an AAV-4 serotype. In some embodiments, an AAV vector or system thereof capable of producing AAV particles capable of targeting the liver can be configured to generate an AAV having an AAV-8 serotype. In some embodiments, the AAV vector is a hybrid AAV vector or system thereof. Hybrid AAVs are AAVs that include genomes with elements from one serotype that are packaged into a capsid derived from at least one different serotype. For example, if it is the rAAV2/5 that is to be produced, and if the production method is based on the helper-free, transient transfection method discussed above, the 1st plasmid and the 3rd plasmid (the adeno helper plasmid) will be the same as discussed for rAAV2 production. However, the second plasmid, the pRepCap will be different. In this plasmid, called pRep2/Cap5, the Rep gene is still derived from AAV2, while the Cap gene is derived from AAV5. The production scheme is the same as the above-mentioned approach for AAV2 production. The resulting rAAV is called rAAV2/5, in which the genome is based on recombinant AAV2, while the capsid is based on AAV5. It is assumed the cell or tissue-tropism displayed by this AAV2/5 hybrid virus should be the same as that of AAV5.

A tabulation of certain AAV serotypes as to these cells can be found in Grimm, D. et al, J. Virol. 82: 5887-5911 (2008), which is recapitulated in Table 9 below.

the "gutless" AAV vector or system thereof can have the cis-acting viral DNA elements involved in genome amplification and packaging in linkage with the heterologous sequences of interest (e.g. the CRISPR-Cas system polynucleotide(s)).

In some embodiments, the AAV vectors are produced in insect cells, e.g., Spodoptera frugiperda Sf9 insect cells, grown in serum-free suspension culture. Serum-free insect cells can be purchased from commercial vendors, e.g., Sigma Aldrich (EX-CELL 405).

In some embodiments, an AAV vector or vector system can contain or consists essentially of one or more polynucleotides encoding one or more components of a CRISPR system. In some embodiments, the AAV vector or vector system can contain a plurality of cassettes comprising or consisting a first cassette comprising or consisting essentially of a promoter, a nucleic acid molecule encoding a CRISPR-associated (Cas) protein (putative nuclease or helicase proteins), e.g., a Cas protein and a terminator, and a two, or more, advantageously up to the packaging size limit of the vector, e.g., in total (including the first cassette) five, cassettes comprising or consisting essentially of a promoter, nucleic acid molecule encoding guide RNA (gRNA) and a terminator (e.g., each cassette schematically represented as Promoter-gRNA1-terminator, Promoter-gRNA2-terminator . . . Promoter-gRNA(N)-terminator (where N is a number that can be inserted that is at an upper limit of the packaging size limit of the vector), or two or more individual rAAVs, each containing one or more than one cassette of a CRISPR system, e.g., a first rAAV containing the first cassette comprising or consisting essentially of a promoter, a nucleic acid molecule encoding Cas, e.g., a Cas and a terminator, and a second rAAV containing a plurality, four, cassettes comprising or consisting essentially of a promoter, nucleic acid molecule encoding guide RNA (gRNA) and a terminator (e.g., each cassette schematically represented as Promoter-gRNA1-terminator, Promoter-gRNA2-terminator . . . Promoter-gRNA(N)-terminator (where N is a number that can be inserted that is at an upper limit of the packaging size limit of the vector). As rAAV is a DNA virus, the nucleic acid molecules in the herein discussion concerning AAV or rAAV are advantageously DNA. In some embodiments, the promoter is a tissue specific promoter or

TABLE 9

| Cell Line | AAV-1 | AAV-2 | AAV-3 | AAV-4 | AAV-5 | AAV-6 | AAV-8 | AAV-9 |
| --- | --- | --- | --- | --- | --- | --- | --- | --- |
| Huh-7 | 13 | 100 | 2.5 | 0.0 | 0.1 | 10 | 0.7 | 0.0 |
| HEK293 | 25 | 100 | 2.5 | 0.1 | 0.1 | 5 | 0.7 | 0.1 |
| HeLa | 3 | 100 | 2.0 | 0.1 | 6.7 | 1 | 0.2 | 0.1 |
| HepG2 | 3 | 100 | 16.7 | 0.3 | 1.7 | 5 | 0.3 | ND |
| Hep1A | 20 | 100 | 0.2 | 1.0 | 0.1 | 1 | 0.2 | 0.0 |
| 911 | 17 | 100 | 11 | 0.2 | 0.1 | 17 | 0.1 | ND |
| CHO | 100 | 100 | 14 | 1.4 | 333 | 50 | 10 | 1.0 |
| COS | 33 | 100 | 33 | 3.3 | 5.0 | 14 | 2.0 | 0.5 |
| MeWo | 10 | 100 | 20 | 0.3 | 6.7 | 10 | 1.0 | 0.2 |
| NIH3T3 | 10 | 100 | 2.9 | 2.9 | 0.3 | 10 | 0.3 | ND |
| A549 | 14 | 100 | 20 | ND | 0.5 | 10 | 0.5 | 0.1 |
| HT1180 | 20 | 100 | 10 | 0.1 | 0.3 | 33 | 0.5 | 0.1 |
| Monocytes | 1111 | 100 | ND | ND | 125 | 1429 | ND | ND |
| Immature DC | 2500 | 100 | ND | ND | 222 | 2857 | ND | ND |
| Mature DC | 2222 | 100 | ND | ND | 333 | 3333 | ND | ND |

In some embodiments, the AAV vector or system thereof is configured as a "gutless" vector, similar to that described in connection with a retroviral vector. In some embodiments, another tissue specific regulatory element. Suitable tissue specific regulatory elements, including promoters, are described in greater detail elsewhere herein.

In another embodiment, the invention provides a non-naturally occurring or engineered CRISPR protein associated with Adeno Associated Virus (AAV), e.g., an AAV comprising a CRISPR protein as a fusion, with or without a linker, to or with an AAV capsid protein such as VP1, VP2, and/or VP3; and, for shorthand purposes, such a non-naturally occurring or engineered CRISPR protein is herein termed a "AAV-CRISPR protein" More in particular, modifying the knowledge in the art, e.g., Rybniker et al., "Incorporation of Antigens into Viral Capsids Augments Immunogenicity of Adeno-Associated Virus Vector-Based Vaccines," J Virol. December 2012; 86(24): 13800-13804, Lux K, et al. 2005. Green fluorescent protein-tagged adeno-associated virus particles allow the study of cytosolic and nuclear trafficking. J. Virol. 79:11776-11787, Munch R C, et al. 2012. "Displaying high-affinity ligands on adeno-associated viral vectors enables tumor cell-specific and safe gene transfer." Mol. Ther. [Epub ahead of print.] doi:10.1038/mt.2012.186 and Warrington K H, Jr, et al. 2004. Adeno-associated virus type 2 VP2 capsid protein is nonessential and can tolerate large peptide insertions at its N terminus. J. Virol. 78:6595-6609, each incorporated herein by reference, one can obtain a modified AAV capsid of the invention. It will be understood by those skilled in the art that the modifications described herein if inserted into the AAV cap gene may result in modifications in the VP1, VP2 and/or VP3 capsid subunits. Alternatively, the capsid subunits can be expressed independently to achieve modification in only one or two of the capsid subunits (VP1, VP2, VP3, VP1+VP2, VP1+VP3, or VP2+VP3). One can modify the cap gene to have expressed at a desired location a non-capsid protein advantageously a large payload protein, such as a CRISPR-protein. Likewise, these can be fusions, with the protein, e.g., large payload protein such as a CRISPR-protein fused in a manner analogous to prior art fusions. See, e.g., US Patent Publication 20090215879; Nance et al., "Perspective on Adeno-Associated Virus Capsid Modification for Duchenne Muscular Dystrophy Gene Therapy," Hum Gene Ther. 26(12):786-800 (2015) and documents cited therein, incorporated herein by reference. The skilled person, from this disclosure and the knowledge in the art can make and use modified AAV or AAV capsid as in the herein invention, and through this disclosure one knows now that large payload proteins can be fused to the AAV capsid. Applicants provide AAV capsid-CRISPR protein (e.g., Cas, (e.g. Type II-D Cas), dCas (e.g. dType II-D Cas) fusions and those AAV-capsid CRISPR protein (e.g., Type II-D Cas) fusions can be a recombinant AAV that contains nucleic acid molecule(s) encoding or providing CRISPR-Cas or CRISPR system or complex RNA guide(s), whereby the CRISPR protein (e.g., Type II-D Cas) fusion delivers a CRISPR-Cas or CRISPR system complex (e.g., the CRISPR protein or Cas (e.g. Type II-D Cas) is provided by the fusion, e.g., VP1, VP2, or VP3 fusion, and the guide RNA is provided by the coding of the recombinant virus, whereby in vivo, in a cell, the CRISPR-Cas or CRISPR system is assembled from the nucleic acid molecule(s) of the recombinant providing the guide RNA and the outer surface of the virus providing the CRISPR-Enzyme (e.g., Type II-D Cas). Such as complex may herein be termed an "AAV-CRISPR system" or an "AAV-CRISPR-Cas" or "AAV-CRISPR complex" or AAV-CRISPR-Cas complex." Accordingly, the instant invention is also applicable to a virus in the genus Dependoparvovirus or in the family Parvoviridae, for instance, AAV, or a virus of Amdoparvovirus, e.g., Carnivore amdoparvovirus 1, a virus of Aveparvovirus, e.g., Galliform aveparvovirus 1, a virus of Bocaparvovirus, e.g., Ungulate bocaparvovirus 1, a virus of Copiparvovirus, e.g., Ungulate copiparvovirus 1, a virus of Dependoparvovirus, e.g., Adeno-associated dependoparvovirus A, a virus of Erythroparvovirus, e.g., Primate erythroparvovirus 1, a virus of Protoparvovirus, e.g., Rodent protoparvovirus 1, a virus of Tetraparvovirus, e.g., Primate tetraparvovirus 1. Thus, a virus of within the family Parvoviridae or the genus Dependoparvovirus or any of the other foregoing genera within Parvoviridae is contemplated as within the invention with discussion herein as to AAV applicable to such other viruses.

In some embodiments, the CRISPR enzyme is external to the capsid or virus particle. In the sense that it is not inside the capsid (enveloped or encompassed with the capsid), but is externally exposed so that it can contact the target genomic DNA). In some embodiments, the CRISPR enzyme is associated with the AAV VP2 domain by way of a fusion protein. In some embodiments, the association may be considered to be a modification of the VP2 domain. Where reference is made herein to a modified VP2 domain, then this will be understood to include any association discussed herein of the VP2 domain and the CRISPR enzyme. In some embodiments, the AAV VP2 domain may be associated (or tethered) to the CRISPR enzyme via a connector protein, for example using a system such as the streptavidin-biotin system. In an embodiment, the present invention provides a polynucleotide encoding the present CRISPR enzyme and associated AAV VP2 domain. In one embodiment, the invention provides a non-naturally occurring modified AAV having a VP2-CRISPR enzyme capsid protein, wherein the CRISPR enzyme is part of or tethered to the VP2 domain. In some preferred embodiments, the CRISPR enzyme is fused to the VP2 domain so that, in another embodiment, the invention provides a non-naturally occurring modified AAV having a VP2-CRISPR enzyme fusion capsid protein. Thus, reference herein to a VP2-CRISPR enzyme capsid protein may also include a VP2-CRISPR enzyme fusion capsid protein. In some embodiments, the VP2-CRISPR enzyme capsid protein further comprises a linker, whereby the VP2-CRISPR enzyme is distanced from the remainder of the AAV. In some embodiments, the VP2-CRISPR enzyme capsid protein further comprises at least one protein complex, e.g., CRISPR complex, such as a CRISPR-Cas complex guide RNA that targets a particular DNA, TALE, etc. A CRISPR complex, such as CRISPR-Cas system comprising the VP2-CRISPR enzyme capsid protein and at least one CRISPR complex, such as a CRISPR-Cas complex guide RNA that targets a particular DNA, is also provided in one embodiment.

In one embodiment, the invention provides a non-naturally occurring or engineered composition comprising a CRISPR enzyme which is part of or tethered to an AAV capsid domain, i.e., VP1, VP2, or VP3 domain of Adeno-Associated Virus (AAV) capsid. In some embodiments, part of or tethered to an AAV capsid domain includes associated with associated with a AAV capsid domain. In some embodiments, the CRISPR enzyme may be fused to the AAV capsid domain. In some embodiments, the fusion may be to the N-terminal end of the AAV capsid domain. As such, in some embodiments, the C-terminal end of the CRISPR enzyme is fused to the N-terminal end of the AAV capsid domain. In some embodiments, an NLS and/or a linker (such as a GlySer linker) may be positioned between the C-terminal end of the CRISPR enzyme and the N-terminal end of the AAV capsid domain. In some embodiments, the fusion may be to the C-terminal end of the AAV capsid domain. In some embodiments, this is not preferred due to the fact that the VP1, VP2 and VP3 domains of AAV are alternative splices of the same RNA and so a C-terminal fusion may affect all three domains. In some embodiments, the AAV capsid domain is truncated. In some embodiments, some or all of the AAV capsid domain is removed. In some embodiments, some of the AAV capsid domain is removed and replaced with a linker (such as a GlySer linker), typically leaving the N-terminal and C-terminal ends of the AAV capsid domain intact, such as the first 2, 5 or 10 amino acids. In this way, the internal (non-terminal) portion of the VP3 domain may be replaced with a linker. It is particularly preferred that the linker is fused to the CRISPR protein. A branched linker may be used, with the CRISPR protein fused to the end of one of the branches. This allows for some degree of spatial separation between the capsid and the CRISPR protein. In this way, the CRISPR protein is part of (or fused to) the AAV capsid domain.

In other embodiments, the CRISPR enzyme may be fused in frame within, i.e. internal to, the AAV capsid domain. Thus, in some embodiments, the AAV capsid domain again preferably retains its N-terminal and C-terminal ends. In this case, a linker is preferred, in some embodiments, either at one or both ends of the CRISPR enzyme. In this way, the CRISPR enzyme is again part of (or fused to) the AAV capsid domain. In certain embodiments, the positioning of the CRISPR enzyme is such that the CRISPR enzyme is at the external surface of the viral capsid once formed. In one embodiment, the invention provides a non-naturally occurring or engineered composition comprising a CRISPR enzyme associated with a AAV capsid domain of Adeno-Associated Virus (AAV) capsid. Here, associated may mean in some embodiments fused, or in some embodiments bound to, or in some embodiments tethered to. The CRISPR protein may, in some embodiments, be tethered to the VP1, VP2, or VP3 domain. This may be via a connector protein or tethering system such as the biotin-streptavidin system. In one example, a biotinylation sequence (15 amino acids) could therefore be fused to the CRISPR protein. When a fusion of the AAV capsid domain, especially the N-terminus of the AAV AAV capsid domain, with streptavidin is also provided, the two will therefore associate with very high affinity. Thus, in some embodiments, provided is a composition or system comprising a CRISPR protein-biotin fusion and a streptavidin-AAV capsid domain arrangement, such as a fusion. The CRISPR protein-biotin and streptavidin-AAV capsid domain forms a single complex when the two parts are brought together. NLSs may also be incorporated between the CRISPR protein and the biotin; and/or between the streptavidin and the AAV capsid domain.

As such, provided is a fusion of a CRISPR enzyme with a connector protein specific for a high affinity ligand for that connector, whereas the AAV VP2 domain is bound to said high affinity ligand. For example, streptavidin may be the connector fused to the CRISPR enzyme, while biotin may be bound to the AAV VP2 domain. Upon co-localization, the streptavidin will bind to the biotin, thus connecting the CRISPR enzyme to the AAV VP2 domain. The reverse arrangement is also possible. In some embodiments, a biotinylation sequence (15 amino acids) could therefore be fused to the AAV VP2 domain, especially the N-terminus of the AAV VP2 domain. A fusion of the CRISPR enzyme with streptavidin is also preferred, in some embodiments. In some embodiments, the biotinylated AAV capsids with streptavidin-CRISPR enzyme are assembled in vitro. This way the AAV capsids should assemble in a straightforward manner and the CRISPR enzyme-streptavidin fusion can be added after assembly of the capsid. In other embodiments a biotinylation sequence (15 amino acids) could therefore be fused to the CRISPR enzyme, together with a fusion of the AAV VP2 domain, especially the N-terminus of the AAV VP2 domain, with streptavidin. For simplicity, a fusion of the CRISPR enzyme and the AAV VP2 domain is preferred in some embodiments. In some embodiments, the fusion may be to the N-terminal end of the CRISPR enzyme. In other words, in some embodiments, the AAV and CRISPR enzyme are associated via fusion. In some embodiments, the AAV and CRISPR enzyme are associated via fusion including a linker. Suitable linkers are discussed herein and include, but are not limited to, Gly Ser linkers. Fusion to the N-term of AAV VP2 domain is preferred, in some embodiments. In some embodiments, the CRISPR enzyme comprises at least one Nuclear Localization Signal (NLS). In a further embodiment, the present invention provides compositions comprising the CRISPR enzyme and associated AAV VP2 domain or the polynucleotides or vectors described herein. Such compositions and formulations are discussed elsewhere herein.

An alternative tether may be to fuse or otherwise associate the AAV capsid domain to an adaptor protein which binds to or recognizes to a corresponding RNA sequence or motif. In some embodiments, the adaptor is or comprises a binding protein which recognizes and binds (or is bound by) an RNA sequence specific for said binding protein. In some embodiments, a preferred example is the MS2 (see e.g., Konermann et al. December 2014, cited infra, incorporated herein by reference) binding protein which recognizes and binds (or is bound by) an RNA sequence specific for the MS2 protein.

With the AAV capsid domain associated with the adaptor protein, the CRISPR protein may, in some embodiments, be tethered to the adaptor protein of the AAV capsid domain. The CRISPR protein may, in some embodiments, be tethered to the adaptor protein of the AAV capsid domain via the CRISPR enzyme being in a complex with a modified guide, see Konermann et al. The modified guide is, in some embodiments, a sgRNA. In some embodiments, the modified guide comprises a distinct RNA sequence; see, e.g., International Patent Application No. PCT/US14/70175, incorporated herein by reference.

In some embodiments, distinct RNA sequence is an aptamer. Thus, corresponding aptamer-adaptor protein systems are preferred. One or more functional domains may also be associated with the adaptor protein. An example of a preferred arrangement would be: [AAV AAV capsid domain-adaptor protein]-[modified guide-CRISPR protein].

In certain embodiments, the positioning of the CRISPR protein is such that the CRISPR protein is at the internal surface of the viral capsid once formed. In one embodiment, the invention provides a non-naturally occurring or engineered composition comprising a CRISPR protein associated with an internal surface of an AAV capsid domain. Here again, associated may mean in some embodiments fused, or in some embodiments bound to, or in some embodiments tethered to. The CRISPR protein may, in some embodiments, be tethered to the VP1, VP2, or VP3 domain such that it locates to the internal surface of the viral capsid once formed. This may be via a connector protein or tethering system such as the biotin-streptavidin system as described above and/or elsewhere herein.

In one embodiment, the invention provides an engineered, non-naturally occurring CRISPR-Cas system comprising a AAV-Cas protein and a guide RNA that targets a DNA molecule encoding a gene product in a cell, whereby the guide RNA targets the DNA molecule encoding the gene product and the Cas protein cleaves the DNA molecule encoding the gene product, whereby expression of the gene product is altered; and, wherein the Cas protein and the guide RNA do not naturally occur together. The invention comprehends the guide RNA comprising a guide sequence fused to a tracr sequence. In a preferred embodiment the Cas protein is a Cas protein. In some embodiments, the polynucleotide encoding the Cas protein is codon optimized for expression in a eukaryotic cell. In some embodiments, the eukaryotic cell is a mammalian cell and in a more preferred embodiment the mammalian cell is a human cell. In a further embodiment, the expression of the gene product is decreased.

In another embodiment, the invention provides an engineered, non-naturally occurring vector system comprising one or more vectors comprising a first regulatory element operably linked to a CRISPR-Cas system guide RNA that targets a DNA molecule encoding a gene product and an AAV-Cas protein. The components may be located on same or different vectors of the system or may be the same vector whereby the AAV-Cas protein also delivers the RNA of the CRISPR system. The guide RNA targets the DNA molecule encoding the gene product in a cell and the AAV-Cas protein may cleaves the DNA molecule encoding the gene product (it may cleave one or both strands or have substantially no nuclease activity), whereby expression of the gene product is altered; and, wherein the AAV-Cas protein and the guide RNA do not naturally occur together. The invention comprehends the guide RNA comprising a guide sequence fused to a tracr sequence. In an embodiment of the invention the AAV-Cas protein is a type II AAV—CRISPR-Cas protein and in a preferred embodiment the AAV-Cas protein is an AAV-Cas protein. The invention further comprehends the coding for the AAV-Cas protein being codon optimized for expression in a eukaryotic cell. In a preferred embodiment the eukaryotic cell is a mammalian cell and in a more preferred embodiment the mammalian cell is a human cell. In a further embodiment of the invention, the expression of the gene product is decreased.

In one embodiment, the invention provides a vector system comprising one or more vectors. In some embodiments, the system comprises: (a) a first regulatory element operably linked to a tracr mate sequence and one or more insertion sites for inserting one or more guide sequences upstream of the tracr mate sequence, wherein when expressed, the guide sequence directs sequence-specific binding of a AAV-CRISPR complex to a target sequence in a eukaryotic cell, wherein the CRISPR complex comprises a AAV-CRISPR enzyme complexed with (1) the guide sequence that is hybridized to the target sequence, and (2) the tracr mate sequence that is hybridized to the tracr sequence; and (b) said AAV-CRISPR enzyme comprising at least one nuclear localization sequence and/or at least one NES; wherein components (a) and (b) are located on or in the same or different vectors of the system. In some embodiments, component (a) further comprises the tracr sequence downstream of the tracr mate sequence under the control of the first regulatory element. In some embodiments, component (a) further comprises two or more guide sequences operably linked to the first regulatory element, wherein when expressed, each of the two or more guide sequences direct sequence specific binding of an AAV-CRISPR complex to a different target sequence in a eukaryotic cell. In some embodiments, the system comprises the tracr sequence under the control of a third regulatory element, such as a polymerase III promoter. In some embodiments, the tracr sequence exhibits at least 50%, 60%, 70%, 80%, 90%, 95%, or 99% of sequence complementarity along the length of the tracr mate sequence when optimally aligned. Determining optimal alignment is within the purview of one of skill in the art. For example, there are publicly and commercially available alignment algorithms and programs such as, but not limited to, Clustal W, Smith-Waterman in matlab, Bowtie, Geneious, Biopython and SeqMan. In some embodiments, the AAV-CRISPR complex comprises one or more nuclear localization sequences of sufficient strength to drive accumulation of said CRISPR complex in a detectable amount in the nucleus of a eukaryotic cell. Without wishing to be bound by theory, it is believed that a nuclear localization sequence is not necessary for AAV-CRISPR complex activity in eukaryotes, but that including such sequences enhances activity of the system, especially as to targeting nucleic acid molecules in the nucleus and/or having molecules exit the nucleus. In some embodiments, the AAV-CRISPR enzyme is an AAV-Cas enzyme. In some embodiments, the AAV-Cas enzyme is derived from *S. pneumoniae, S. pyogenes, S. thermophiles, F. novicida* or *S. aureus* Type II-D Cas (e.g., a Cas protein of one of these organisms modified to have or be associated with at least one AAV) and may include further mutations or alterations or be a chimeric Cas9. The enzyme may be an AAV-Type II-D Cas homolog or ortholog. In some embodiments, the AAV-CRISPR enzyme is codon-optimized for expression in a eukaryotic cell. In some embodiments, the AAV-CRISPR enzyme directs cleavage of one or two strands at the location of the target sequence. In some embodiments, the AAV-CRISPR enzyme lacks DNA strand cleavage activity. In some embodiments, the first regulatory element is a polymerase III promoter. In some embodiments, the second regulatory element is a polymerase II promoter. In some embodiments, the guide sequence is at least 15, 16, 17, 18, 19, 20, 25 nucleotides, or between 10-30, or between 15-25, or between 15-20 nucleotides in length.

In general, in some embodiments, the AAV further comprises a repair template. It will be appreciated that comprises here may mean encompassed within the viral capsid or that the virus encodes the comprised protein. In some embodiments, one or more, preferably two or more guide RNAs, may be comprised/encompassed within the AAV vector. Two may be preferred, in some embodiments, as it allows for multiplexing or dual nickase approaches. Particularly for multiplexing, two or more guides may be used. In fact, in some embodiments, three or more, four or more, five or more, or even six or more guide RNAs may be comprised/encompassed within the AAV. More space has been freed up within the AAV by virtue of the fact that the AAV no longer needs to comprise/encompass the CRISPR enzyme. In each of these instances, a repair template may also be provided comprised/encompassed within the AAV. In some embodiments, the repair template corresponds to or includes the DNA target.

Herpes Simplex Viral Vectors

In some embodiments, the vector can be a Herpes Simplex Viral (HSV)-based vector or system thereof. HSV systems can include the disabled infections single copy (DISC) viruses, which are composed of a glycoprotein H defective mutant HSV genome. When the defective HSV is propagated in complementing cells, virus particles can be generated that are capable of infecting subsequent cells permanently replicating their own genome but are not capable of producing more infectious particles. See e.g., 2009. Trobridge. Exp. Opin. Biol. Ther. 9:1427-1436, whose techniques and vectors described therein can be modified and adapted for use in the CRISPR-Cas system of the present invention. In some embodiments where an HSV vector or system thereof is utilized, the host cell can be a complementing cell. In some embodiments, HSV vector or system thereof can be capable of producing virus particles capable of delivering a polynucleotide cargo of up to 150 kb. Thus, in some embodiment the CRISPR-Cas system polynucleotide(s) included in the HSV-based viral vector or system thereof can sum from about 0.001 to about 150 kb. HSV-based vectors and systems thereof have been successfully used in several contexts including various models of neurologic disorders. See e.g., Cockrell et al. 2007. Mol. Biotechnol. 36:184-204; Kafri T. 2004. Mol. Biol. 246:367-390; Balaggan and Ali. 2012. Gene Ther. 19:145-153; Wong et al. 2006. Hum. Gen. Ther. 2002. 17:1-9; Azzouz et al. J. Neruosci. 22L10302-10312; and Betchen and Kaplitt. 2003. Curr. Opin. Neurol. 16:487-493, whose techniques and vectors described therein can be modified and adapted for use in the CRISPR-Cas system of the present invention.

Poxvirus Vectors

In some embodiments, the vector can be a poxvirus vector or system thereof. In some embodiments, the poxvirus vector can result in cytoplasmic expression of one or more CRISPR-Cas system polynucleotides of the present invention. In some embodiments the capacity of a poxvirus vector or system thereof can be about 25 kb or more. In some embodiments, a poxvirus vector or system thereof can include one or more CRISPR-Cas system polynucleotides described herein.

Viral Vectors for Delivery to Plants

The systems and compositions may be delivered to plant cells using viral vehicles. In particular embodiments, the compositions and systems may be introduced in the plant cells using a plant viral vector (e.g., as described in Scholthof et al. 1996, Annu Rev Phytopathol. 1996; 34:299-323). Such viral vector may be a vector from a DNA virus, e.g., geminivirus (e.g., cabbage leaf curl virus, bean yellow dwarf virus, wheat dwarf virus, tomato leaf curl virus, maize streak virus, tobacco leaf curl virus, or tomato golden mosaic virus) or nanovirus (e.g., Faba bean necrotic yellow virus). The viral vector may be a vector from an RNA virus, e.g., tobravirus (e.g., tobacco rattle virus, tobacco mosaic virus), potexvirus (e.g., potato virus X), or hordeivirus (e.g., barley stripe mosaic virus). The replicating genomes of plant viruses may be non-integrative vectors.

Virus Particle Production from Viral Vectors
Retroviral Production

In some embodiments, one or more viral vectors and/or system thereof can be delivered to a suitable cell line for production of virus particles containing the polynucleotide or other payload to be delivered to a host cell. Suitable host cells for virus production from viral vectors and systems thereof described herein are known in the art and are commercially available. For example, suitable host cells include HEK 293 cells and its variants (HEK 293T and HEK 293TN cells). In some embodiments, the suitable host cell for virus production from viral vectors and systems thereof described herein can stably express one or more genes involved in packaging (e.g. pol, gag, and/or VSV-G) and/or other supporting genes.

In some embodiments, after delivery of one or more viral vectors to the suitable host cells for or virus production from viral vectors and systems thereof, the cells are incubated for an appropriate length of time to allow for viral gene expression from the vectors, packaging of the polynucleotide to be delivered (e.g., an CRISPR-Cas system polynucleotide), and virus particle assembly, and secretion of mature virus particles into the culture media. Various other methods and techniques are generally known to those of ordinary skill in the art.

Mature virus particles can be collected from the culture media by a suitable method. In some embodiments, this can involve centrifugation to concentrate the virus. The titer of the composition containing the collected virus particles can be obtained using a suitable method. Such methods can include transducing a suitable cell line (e.g., NIH 3T3 cells) and determining transduction efficiency, infectivity in that cell line by a suitable method. Suitable methods include PCR-based methods, flow cytometry, and antibiotic selection-based methods. Various other methods and techniques are generally known to those of ordinary skill in the art. The concentration of virus particle can be adjusted as needed. In some embodiments, the resulting composition containing virus particles can contain $1\times10^1-1\times10^{20}$ particles/mL.

Lentiviruses may be prepared from any lentiviral vector or vector system described herein. In one example embodiment, after cloning pCasES10 (which contains a lentiviral transfer plasmid backbone), HEK293FT at low passage (p=5) can be seeded in a T-75 flask to 50% confluence the day before transfection in DMEM with 10% fetal bovine serum and without antibiotics. After 20 hours, the media can be changed to OptiMEM (serum-free) media and transfection of the lentiviral vectors can done 4 hours later. Cells can be transfected with 10 µg of lentiviral transfer plasmid (pCasES10) and the appropriate packaging plasmids (e.g., 5 µg of pMD2.G (VSV-g pseudotype), and 7.5 ug of psPAX2 (gag/pol/rev/tat)). Transfection can be carried out in 4 mL OptiMEM with a cationic lipid delivery agent (50 uL Lipofectamine 2000 and 100 ul Plus reagent). After 6 hours, the media can be changed to antibiotic-free DMEM with 10% fetal bovine serum. These methods can use serum during cell culture, but serum-free methods are preferred.

Following transfection and allowing the producing cells (also referred to as packaging cells) to package and produce virus particles with packaged cargo, the lentiviral particles can be purified. In an exemplary embodiment, virus-containing supernatants can be harvested after 48 hours. Collected virus-containing supernatants can first be cleared of debris and filtered through a 0.45 um low protein binding (PVDF) filter. They can then be spun in an ultracentrifuge for 2 hours at 24,000 rpm. The resulting virus-containing pellets can be resuspended in 50 ul of DMEM overnight at 4 degrees C. They can be then aliquoted and used immediately or immediately frozen at −80 degrees C. for storage.

AAV Particle Production

There are two main strategies for producing AAV particles from AAV vectors and systems thereof, such as those described herein, which depend on how the adenovirus helper factors are provided (helper v. helper free). In some embodiments, a method of producing AAV particles from AAV vectors and systems thereof can include adenovirus infection into cell lines that stably harbor AAV replication and capsid encoding polynucleotides along with AAV vector containing the polynucleotide to be packaged and delivered by the resulting AAV particle (e.g., the CRISPR-Cas system polynucleotide(s)). In some embodiments, a method of producing AAV particles from AAV vectors and systems thereof can be a "helper free" method, which includes co-transfection of an appropriate producing cell line with three vectors (e.g., plasmid vectors): (1) an AAV vector that contains a polynucleotide of interest (e.g. the CRISPR-Cas system polynucleotide(s)) between 2 ITRs; (2) a vector that carries the AAV Rep-Cap encoding polynucleotides; and (helper polynucleotides. One of skill in the art will appreciate various methods and variations thereof that are both helper and -helper free and as well as the different advantages of each system.

Non-Viral Vectors

In some embodiments, the vector is a non-viral vector or vector system. The term of art "Non-viral vector" and as used herein in this context refers to molecules and/or compositions that are vectors but that are not based on one or more component of a virus or virus genome (excluding any nucleotide to be delivered and/or expressed by the non-viral vector) that can be capable of incorporating CRISPR-Cas polynucleotide(s) and delivering said CRISPR-Cas polynucleotide(s) to a cell and/or expressing the polynucleotide in the cell. It will be appreciated that this does not exclude vectors containing a polynucleotide designed to target a virus-based polynucleotide that is to be delivered. For example, if a gRNA to be delivered is directed against a virus component and it is inserted or otherwise coupled to an otherwise non-viral vector or carrier, this would not make said vector a "viral vector". Non-viral vectors can include, without limitation, naked polynucleotides and polynucleotide (non-viral) based vector and vector systems.

Naked Polynucleotides

In some embodiments one or more CRISPR-Cas system polynucleotides described elsewhere herein can be included in a naked polynucleotide. The term of art "naked polynucleotide" as used herein refers to polynucleotides that are not associated with another molecule (e.g., proteins, lipids, and/or other molecules) that can often help protect it from environmental factors and/or degradation. As used herein, associated with includes, but is not limited to, linked to, adhered to, adsorbed to, enclosed in, enclosed in or within, mixed with, and the like. Naked polynucleotides that include one or more of the CRISPR-Cas system polynucleotides described herein can be delivered directly to a host cell and optionally expressed therein. The naked polynucleotides can have any suitable two- and three-dimensional configurations. By way of non-limiting examples, naked polynucleotides can be single-stranded molecules, double stranded molecules, circular molecules (e.g., plasmids and artificial chromosomes), molecules that contain portions that are single stranded and portions that are double stranded (e.g., ribozymes), and the like. In some embodiments, the naked polynucleotide contains only the CRISPR-Cas system polynucleotide(s) of the present invention. In some embodiments, the naked polynucleotide can contain other nucleic acids and/or polynucleotides in addition to the CRISPR-Cas system polynucleotide(s) of the present invention. The naked polynucleotides can include one or more elements of a transposon system. Transposons and system thereof are described in greater detail elsewhere herein.

Non-Viral Polynucleotide Vectors

In some embodiments, one or more of the CRISPR-Cas system polynucleotides can be included in a non-viral polynucleotide vector. Suitable non-viral polynucleotide vectors include, but are not limited to, transposon vectors and vector systems, plasmids, bacterial artificial chromosomes, yeast artificial chromosomes, AR (antibiotic resistance)-free plasmids and miniplasmids, circular covalently closed vectors (e.g. minicircles, minivectors, miniknots), linear covalently closed vectors ("dumbbell shaped"), MIDGE (minimalistic immunologically defined gene expression) vectors, MiLV (micro-linear vector) vectors, Ministrings, mini-intronic plasmids, PSK systems (post-segregationally killing systems), ORT (operator repressor titration) plasmids, and the like. See e.g., Hardee et al. 2017. Genes. 8(2):65.

In some embodiments, the non-viral polynucleotide vector can have a conditional origin of replication. In some embodiments, the non-viral polynucleotide vector can be an ORT plasmid. In some embodiments, the non-viral polynucleotide vector can have a minimalistic immunologically defined gene expression. In some embodiments, the non-viral polynucleotide vector can have one or more post-segregationally killing system genes. In some embodiments, the non-viral polynucleotide vector is AR-free. In some embodiments, the non-viral polynucleotide vector is a minivector. In some embodiments, the non-viral polynucleotide vector includes a nuclear localization signal. In some embodiments, the non-viral polynucleotide vector can include one or more CpG motifs. In some embodiments, the non-viral polynucleotide vectors can include one or more scaffold/matrix attachment regions (S/MARs). See e.g., Mirkovitch et al. 1984. Cell. 39:223-232, Wong et al. 2015. Adv. Genet. 89:113-152, whose techniques and vectors can be adapted for use in the present invention. S/MARs are AT-rich sequences that play a role in the spatial organization of chromosomes through DNA loop base attachment to the nuclear matrix. S/MARs are often found close to regulatory elements such as promoters, enhancers, and origins of DNA replication. Inclusion of one or S/MARs can facilitate a once-per-cell-cycle replication to maintain the non-viral polynucleotide vector as an episome in daughter cells. In certain embodiments, the S/MAR sequence is located downstream of an actively transcribed polynucleotide (e.g., one or more CRISPR-Cas system polynucleotides of the present invention) included in the non-viral polynucleotide vector. In some embodiments, the S/MAR can be a S/MAR from the beta-interferon gene cluster. See e.g., Verghese et al. 2014. Nucleic Acid Res. 42:e53; Xu et al. 2016. Sci. China Life Sci. 59:1024-1033; Jin et al. 2016. 8:702-711; Koirala et al. 2014. Adv. Exp. Med. Biol. 801:703-709; and Nehlsen et al. 2006. Gene Ther. Mol. Biol. 10:233-244, whose techniques and vectors can be adapted for use in the present invention.

In some embodiments, the non-viral vector is a transposon vector or system thereof. As used herein, "transposon" (also referred to as transposable element) refers to a polynucleotide sequence that is capable of moving form location in a genome to another. There are several classes of transposons. Transposons include retrotransposons and DNA transposons. Retrotransposons require the transcription of the polynucleotide that is moved (or transposed) in order to transpose the polynucleotide to a new genome or polynucleotide. DNA transposons are those that do not require reverse transcription of the polynucleotide that is moved (or transposed) in order to transpose the polynucleotide to a new genome or polynucleotide. In some embodiments, the non-viral polynucleotide vector can be a retrotransposon vector. In some embodiments, the retrotransposon vector includes long terminal repeats. In some embodiments, the retrotransposon vector does not include long terminal repeats. In some embodiments, the non-viral polynucleotide vector can be a DNA transposon vector. DNA transposon vectors can include a polynucleotide sequence encoding a transposase. In some embodiments, the transposon vector is configured as a non-autonomous transposon vector, meaning that the transposition does not occur spontaneously on its own. In some of these embodiments, the transposon vector lacks one or more polynucleotide sequences encoding proteins required for transposition. In some embodiments, the non-autonomous transposon vectors lack one or more Ac elements.

In some embodiments a non-viral polynucleotide transposon vector system can include a first polynucleotide vector that contains the CRISPR-Cas system polynucleotide(s) of the present invention flanked on the 5' and 3' ends by transposon terminal inverted repeats (TIRs) and a second polynucleotide vector that includes a polynucleotide capable of encoding a transposase coupled to a promoter to drive expression of the transposase. When both are expressed in the same cell the transposase can be expressed from the second vector and can transpose the material between the TIRs on the first vector (e.g., the CRISPR-Cas system polynucleotide(s) of the present invention) and integrate it into one or more positions in the host cell's genome. In some embodiments the transposon vector or system thereof can be configured as a gene trap. In some embodiments, the TIRs can be configured to flank a strong splice acceptor site followed by a reporter and/or other gene (e.g., one or more of the CRISPR-Cas system polynucleotide(s) of the present invention) and a strong poly A tail. When transposition occurs while using this vector or system thereof, the transposon can insert into an intron of a gene and the inserted reporter or other gene can provoke a mis-splicing process and as a result it in activates the trapped gene.

Any suitable transposon system can be used. Suitable transposon and systems thereof can include, but are not limited to, Sleeping Beauty transposon system (Tc1/mariner superfamily) (see e.g., Ivics et al. 1997. Cell. 91(4): 501-510), piggyBac (piggyBac superfamily) (see e.g., Li et al. 2013 110(25): E2279-E2287 and Yusa et al. 2011. PNAS. 108(4): 1531-1536), Tol2 (superfamily hAT), Frog Prince (Tc1/mariner superfamily) (see e.g., Miskey et al. 2003 Nucleic Acid Res. 31(23):6873-6881) and variants thereof.

Non-Vector Delivery Vehicles

The delivery vehicles may comprise non-viral vehicles. In general, methods and vehicles capable of delivering nucleic acids and/or proteins may be used for delivering the systems compositions herein. Examples of non-viral vehicles include lipid nanoparticles, cell-penetrating peptides (CPPs), DNA nanoclews, metal nanoparticles, streptolysin O, multifunctional envelope-type nanodevices (MENDs), lipid-coated mesoporous silica particles, and other inorganic nanoparticles.

Lipid Particles

The delivery vehicles may comprise lipid particles, e.g., lipid nanoparticles (LNPs) and liposomes. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Felgner, International Patent Publication Nos. WO 91/17424 and WO 91/16024. The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

Lipid Nanoparticles (LNPs)

LNPs may encapsulate nucleic acids within cationic lipid particles (e.g., liposomes), and may be delivered to cells with relative ease. In some examples, lipid nanoparticles do not contain any viral components, which helps minimize safety and immunogenicity concerns. Lipid particles may be used for in vitro, ex vivo, and in vivo deliveries. Lipid particles may be used for various scales of cell populations.

In some examples. LNPs may be used for delivering DNA molecules (e.g., those comprising coding sequences of Cas and/or gRNA) and/or RNA molecules (e.g., mRNA of Cas, gRNAs). In certain cases, LNPs may be use for delivering RNP complexes of Cas/gRNA.

Components in LNPs may comprise cationic lipids 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinK-DMA), 1,2-dilinoleyl-4-(2-dimethylaminoethyl)-[1,3]-dioxolane (DLinKC2-DMA), (3-o-[2"-(methoxypolyethyleneglycol 2000) succinoyl]-1,2-dimyristoyl-sn-glycol (PEG-S-DMG), R-3-[(ro-methoxy-poly(ethylene glycol) 2000) carbamoyl]-1,2-dimyristyloxlpropyl-3-amine (PEG-C-DOMG, and any combination thereof. Preparation of LNPs and encapsulation may be adapted from Rosin et al, Molecular Therapy, vol. 19, no. 12, pages 1286-2200, December 2011).

In some embodiments, an LNP delivery vehicle can be used to deliver a virus particle containing a CRISPR-Cas system and/or component(s) thereof. In some embodiments, the virus particle(s) can be adsorbed to the lipid particle, such as through electrostatic interactions, and/or can be attached to the liposomes via a linker.

In some embodiments, the LNP contains a nucleic acid, wherein the charge ratio of nucleic acid backbone phosphates to cationic lipid nitrogen atoms is about 1: 1.5-7 or about 1:4.

In some embodiments, the LNP also includes a shielding compound, which is removable from the lipid composition under in vivo conditions. In some embodiments, the shielding compound is a biologically inert compound. In some embodiments, the shielding compound does not carry any charge on its surface or on the molecule as such. In some embodiments, the shielding compounds are polyethyleneglycols (PEGs), hydroxyethylglucose (HEG) based polymers, polyhydroxyethyl starch (polyHES) and polypropylene. In some embodiments, the PEG, HEG, polyHES, and a polypropylene weight between about 500 to 10,000 Da or between about 2000 to 5000 Da. In some embodiments, the shielding compound is PEG2000 or PEG5000.

In some embodiments, the LNP can include one or more helper lipids. In some embodiments, the helper lipid can be a phosphor lipid or a steroid. In some embodiments, the helper lipid is between about 20 mol % to 80 mol % of the total lipid content of the composition. In some embodiments, the helper lipid component is between about 35 mol % to 65 mol % of the total lipid content of the LNP. In some embodiments, the LNP includes lipids at 50 mol % and the helper lipid at 50 mol % of the total lipid content of the LNP.

Other non-limiting, exemplary LNP delivery vehicles are described in U.S. Patent Publication Nos. US 20160174546, US 20140301951, US 20150105538, US 20150250725, Wang et al., J. Control Release, 2017 Jan. 31. pii: 50168-3659(17)30038-X. doi: 10.1016/j.jconrel.2017.01.037. [Epub ahead of print]; Altinoglu et al., Biomater Sci., 4(12):1773-80, Nov. 15, 2016; Wang et al., PNAS, 113(11): 2868-73 Mar. 15, 2016; Wang et al., PloS One, 10(11): e0141860. doi: 10.1371/journal.pone.0141860. eCollection 2015, Nov. 3, 2015; Takeda et al., Neural Regen Res. 10(5):689-90, May 2015; Wang et al., Adv. Healthcare Mater., 3(9):1398-403, September 2014; and Wang et al., Agnew Chem Int Ed Engl., 53(11):2893-8, Mar. 10, 2014; James E. Dahlman and Carmen Barnes et al. Nature Nanotechnology (2014) published online 11 May 2014, doi: 10.1038/nnano.2014.84; Coelho et al., N Engl J Med 2013; 369:819-29; Aleku et al., Cancer Res., 68(23): 9788-98 (Dec. 1, 2008), Strumberg et al., Int. J. Clin. Pharmacol. Ther., 50(1): 76-8 (January 2012), Schultheis et al., J. Clin.

*Oncol.*, 32(36): 4141-48 (Dec. 20, 2014), and Fehring et al., *Mol. Ther.*, 22(4): 811-20 (Apr. 22, 2014); Novobrantseva, Molecular Therapy-Nucleic Acids (2012) 1, e4; doi: 10.1038/mtna.2011.3; WO2012135025; US 20140348900; US 20140328759; US 20140308304; WO 2005/105152; WO 2006/069782; WO 2007/121947; US 2015/082080; US 20120251618; 7,982,027; 7,799,565; 8,058,069; 8,283,333; 7,901,708; 7,745,651; 7,803,397; 8,101,741; 8,188,263; 7,915,399; 8,236,943 and 7,838,658 and European Pat. Nos 1766035; 1519714; 1781593 and 1664316.

Liposomes

In some embodiments, a lipid particle may be liposome. Liposomes are spherical vesicle structures composed of a uni- or multilamellar lipid bilayer surrounding internal aqueous compartments and a relatively impermeable outer lipophilic phospholipid bilayer. In some embodiments, liposomes are biocompatible, nontoxic, can deliver both hydrophilic and lipophilic drug molecules, protect their cargo from degradation by plasma enzymes, and transport their load across biological membranes and the blood brain barrier (BBB).

Liposomes can be made from several different types of lipids, e.g., phospholipids. A liposome may comprise natural phospholipids and lipids such as 1,2-distearoryl-sn-glycero-3-phosphatidyl choline (DSPC), sphingomyelin, egg phosphatidylcholines, monosialoganglioside, or any combination thereof.

Several other additives may be added to liposomes in order to modify their structure and properties. For instance, liposomes may further comprise cholesterol, sphingomyelin, and/or 1,2-dioleoyl-sn-glycero-3-phosphoethanolamine (DOPE), e.g., to increase stability and/or to prevent the leakage of the liposomal inner cargo.

In some embodiments, a liposome delivery vehicle can be used to deliver a virus particle containing a CRISPR-Cas system and/or component(s) thereof. In some embodiments, the virus particle(s) can be adsorbed to the liposome, such as through electrostatic interactions, and/or can be attached to the liposomes via a linker.

In some embodiments, the liposome can be a Trojan Horse liposome (also known in the art as Molecular Trojan Horses), see e.g. http://cshprotocols.cshlp.org/content/2010/4/pdb.prot5407.long, the teachings of which can be applied and/or adapted to generated and/or deliver the CRISPR-Cas systems described herein.

Other non-limiting, exemplary liposomes can be those as set forth in Wang et al., ACS Synthetic Biology, 1, 403-07 (2012); Wang et al., PNAS, 113(11) 2868-2873 (2016); Spuch and Navarro, Journal of Drug Delivery, vol. 2011, Article ID 469679, 12 pages, 2011. doi:10.1155/2011/469679; WO 2008/042973; U.S. Pat. No. 8,071,082; WO 2014/186366; 20160257951; US20160129120; US 20160244761; 20120251618; WO2013/093648; Lipofectin (a combination of DOTMA and DOPE), Lipofectase, LIPOFECTAMINE® (e.g., LIPOFECTAMINE® 2000, LIPOFECTAMINE® 3000, LIPOFECTAMINE® RNAiMAX, LIPOFECTAMINE® LTX), SAINT-RED (Synvolux Therapeutics, Groningen Netherlands), DOPE, Cytofectin (Gilead Sciences, Foster City, Calif), and Eufectins (JBL, San Luis Obispo, Calif.).

Stable Nucleic-Acid-Lipid Particles (SNALPs)

In some embodiments, the lipid particles may be stable nucleic acid lipid particles (SNALPs). SNALPs may comprise an ionizable lipid (DLinDMA) (e.g., cationic at low pH), a neutral helper lipid, cholesterol, a diffusible polyethylene glycol (PEG)-lipid, or any combination thereof. In some examples, SNALPs may comprise synthetic cholesterol, dipalmitoylphosphatidylcholine, 3-N-[(w-methoxy polyethylene glycol)2000)carbamoyl]-1,2-dimyristyloxy-propylamine, and cationic 1,2-dilinoleyloxy-3-N,Ndimethylaminopropane. In some examples, SNALPs may comprise synthetic cholesterol, 1,2-distearoyl-sn-glycero-3-phosphocholine, PEG-cDMA, and 1,2-dilinoleyloxy-3-(N; N-dimethyl)aminopropane (DLinDMAo).

Other non-limiting, exemplary SNALPs that can be used to deliver the CRISPR-Cas systems described herein can be any such SNALPs as described in Morrissey et al., Nature Biotechnology, Vol. 23, No. 8, August 2005, Zimmerman et al., Nature Letters, Vol. 441, 4 May 2006; Geisbert et al., Lancet 2010; 375: 1896-905; Judge, J. Clin. Invest. 119: 661-673 (2009); and Semple et al., Nature Biotechnology, Volume 28 Number 2 Feb. 2010, pp. 172-177.

Other Lipids

The lipid particles may also comprise one or more other types of lipids, e.g., cationic lipids, such as amino lipid 2,2-dilinoleyl-4-dimethylaminoethyl-[1,3]-dioxolane (DLin-KC2-DMA), DLin-KC2-DMA4, C12-200 and colipids distearoylphosphatidyl choline, cholesterol, and PEG-DMG.

In some embodiments, the delivery vehicle can be or include a lipidoid, such as any of those set forth in, for example, US 20110293703.

In some embodiments, the delivery vehicle can be or include an amino lipid, such as any of those set forth in, for example, Jayaraman, Angew. Chem. Int. Ed. 2012, 51, 8529-8533.

In some embodiments, the delivery vehicle can be or include a lipid envelope, such as any of those set forth in, for example, Korman et al., 2011. Nat. Biotech. 29:154-157.

Lipoplexes/Polyplexes

In some embodiments, the delivery vehicles comprise lipoplexes and/or polyplexes. Lipoplexes may bind to negatively charged cell membrane and induce endocytosis into the cells. Examples of lipoplexes may be complexes comprising lipid(s) and non-lipid components. Examples of lipoplexes and polyplexes include FuGENE-6 reagent, a non-liposomal solution containing lipids and other components, zwitterionic amino lipids (ZALs), Ca2þ (e.g., forming DNA/$Ca^{2+}$ microcomplexes), polyethylenimine (PEI) (e.g., branched PEI), and poly(L-lysine) (PLL).

Sugar-Based Particles

In some embodiments, the delivery vehicle can be a sugar-based particle. In some embodiments, the sugar-based particles can be or include GalNAc, such as any of those described in WO2014118272; US 20020150626; Nair, J K et al., 2014, Journal of the American Chemical Society 136 (49), 16958-16961; Ostergaard et al., Bioconjugate Chem., 2015, 26 (8), pp 1451-1455.

Cell Penetrating Peptides

In some embodiments, the delivery vehicles comprise cell penetrating peptides (CPPs). CPPs are short peptides that facilitate cellular uptake of various molecular cargo (e.g., from nanosized particles to small chemical molecules and large fragments of DNA).

CPPs may be of different sizes, amino acid sequences, and charges. In some examples, CPPs can translocate the plasma membrane and facilitate the delivery of various molecular cargoes to the cytoplasm or an organelle. CPPs may be introduced into cells via different mechanisms, e.g., direct penetration in the membrane, endocytosis-mediated entry, and translocation through the formation of a transitory structure.

CPPs may have an amino acid composition that either contains a high relative abundance of positively charged amino acids such as lysine or arginine or has sequences that contain an alternating pattern of polar/charged amino acids and non-polar, hydrophobic amino acids. These two types of structures are referred to as polycationic or amphipathic, respectively. A third class of CPPs are the hydrophobic peptides, containing only apolar residues, with low net charge or have hydrophobic amino acid groups that are crucial for cellular uptake. Another type of CPPs is the trans-activating transcriptional activator (Tat) from Human Immunodeficiency Virus 1 (HIV-1). Examples of CPPs include to Penetratin, Tat (48-60), Transportan, and (R-AhX-R4) (Ahx refers to aminohexanoyl), Kaposi fibroblast growth factor (FGF) signal peptide sequence, integrin β3 signal peptide sequence, polyarginine peptide Args sequence, Guanine rich-molecular transporters, and sweet arrow peptide. Examples of CPPs and related applications also include those described in U.S. Pat. No. 8,372,951.

CPPs can be used for in vitro and ex vivo work quite readily, and extensive optimization for each cargo and cell type is usually required. In some examples, CPPs may be covalently attached to the Cas protein directly, which is then complexed with the gRNA and delivered to cells. In some examples, separate delivery of CPP-Cas and CPP-gRNA to multiple cells may be performed. CPP may also be used to delivery RNPs.

CPPs may be used to deliver the compositions and systems to plants. In some examples, CPPs may be used to deliver the components to plant protoplasts, which are then regenerated to plant cells and further to plants.

DNA Nanoclews

In some embodiments, the delivery vehicles comprise DNA nanoclews. A DNA nanoclew refers to a sphere-like structure of DNA (e.g., with a shape of a ball of yarn). The nanoclew may be synthesized by rolling circle amplification with palindromic sequences that aide in the self-assembly of the structure. The sphere may then be loaded with a payload. An example of DNA nanoclew is described in Sun W et al, J Am Chem Soc. 2014 Oct. 22; 136(42):14722-5; and Sun W et al, Angew Chem Int Ed Engl. 2015 Oct. 5; 54(41):12029-33. DNA nanoclew may have a palindromic sequences to be partially complementary to the gRNA within the Cas:gRNA ribonucleoprotein complex. A DNA nanoclew may be coated, e.g., coated with PEI to induce endosomal escape.

Metal Nanoparticles

In some embodiments, the delivery vehicles comprise gold nanoparticles (also referred to AuNPs or colloidal gold). Gold nanoparticles may form complex with cargos, e.g., Cas:gRNA RNP. Gold nanoparticles may be coated, e.g., coated in a silicate and an endosomal disruptive polymer, PAsp(DET). Examples of gold nanoparticles include AuraSense Therapeutics' Spherical Nucleic Acid (SNA™) constructs, and those described in Mout R, et al. (2017). ACS Nano 11:2452-8; Lee K, et al. (2017). Nat Biomed Eng 1:889-901. Other metal nanoparticles can also be complexed with cargo(s). Such metal particles include, tungsten, palladium, rhodium, platinum, and iridium particles. Other non-limiting, exemplary metal nanoparticles are described in US 20100129793.

iTOP

In some embodiments, the delivery vehicles comprise iTOP. iTOP refers to a combination of small molecules drives the highly efficient intracellular delivery of native proteins, independent of any transduction peptide. iTOP may be used for induced transduction by osmocytosis and propanebetaine, using NaCl-mediated hyperosmolality together with a transduction compound (propanebetaine) to trigger macropinocytotic uptake into cells of extracellular macromolecules. Examples of iTOP methods and reagents include those described in D'Astolfo D S, Pagliero R J, Pras A, et al. (2015). Cell 161:674-690.

Polymer-Based Particles

In some embodiments, the delivery vehicles may comprise polymer-based particles (e.g., nanoparticles). In some embodiments, the polymer-based particles may mimic a viral mechanism of membrane fusion. The polymer-based particles may be a synthetic copy of Influenza virus machinery and form transfection complexes with various types of nucleic acids ((siRNA, miRNA, plasmid DNA or shRNA, mRNA) that cells take up via the endocytosis pathway, a process that involves the formation of an acidic compartment. The low pH in late endosomes acts as a chemical switch that renders the particle surface hydrophobic and facilitates membrane crossing. Once in the cytosol, the particle releases its payload for cellular action. This Active Endosome Escape technology is safe and maximizes transfection efficiency as it is using a natural uptake pathway. In some embodiments, the polymer-based particles may comprise alkylated and carboxyalkylated branched polyethylenimine. In some examples, the polymer-based particles are VIROMER, e.g., VIROMER RNAi, VIROMER RED, VIROMER mRNA, VIROMER CRISPR. Example methods of delivering the systems and compositions herein include those described in Bawage S S et al., Synthetic mRNA expressed Cas13a mitigates RNA virus infections, www.biorxiv.org/content/10.1101/370460v1.full doi: doi.org/10.1101/370460, Viromer® RED, a powerful tool for transfection of keratinocytes. doi: 10.13140/RG.2.2.16993.61281, Viromer® Transfection—Factbook 2018: technology, product overview, users' data, doi: 10.13140/RG.2.2.23912.16642. Other exemplary and non-limiting polymeric particles are described in US 20170079916, US 20160367686, US 20110212179, US 20130302401, 6,007,845, 5,855,913, 5,985,309, 5,543,158, WO2012135025, US 20130252281, US 20130245107, US 20130244279; US 20050019923, and 20080267903.

Streptolysin O (SLO)

The delivery vehicles may be streptolysin O (SLO). SLO is a toxin produced by Group A streptococci that works by creating pores in mammalian cell membranes. SLO may act in a reversible manner, which allows for the delivery of proteins (e.g., up to 100 kDa) to the cytosol of cells without compromising overall viability. Examples of SLO include those described in Sierig G, et al. (2003). Infect Immun 71:446-55; Walev I, et al. (2001). Proc Natl Acad Sci USA 98:3185-90; Teng K W, et al. (2017). Elife 6:e25460.

Multifunctional Envelope-Type Nanodevice (MEND)

The delivery vehicles may comprise multifunctional envelope-type nanodevice (MENDs). MENDs may comprise condensed plasmid DNA, a PLL core, and a lipid film shell. A MEND may further comprise cell-penetrating peptide (e.g., stearyl octaarginine). The cell penetrating peptide may be in the lipid shell. The lipid envelope may be modified with one or more functional components, e.g., one or more of: polyethylene glycol (e.g., to increase vascular circulation time), ligands for targeting of specific tissues/cells, additional cell-penetrating peptides (e.g., for greater cellular delivery), lipids to enhance endosomal escape, and nuclear delivery tags. In some examples, the MEND may be a tetra-lamellar MEND (T-MEND), which may target the cellular nucleus and mitochondria. In certain examples, a MEND may be a PEG-peptide-DOPE-conjugated MEND (PPD-MEND), which may target bladder cancer cells.

Examples of MENDs include those described in Kogure K, et al. (2004). J Control Release 98:317-23; Nakamura T, et al. (2012). Acc Chem Res 45:1113-21.

Lipid-Coated Mesoporous Silica Particles

The delivery vehicles may comprise lipid-coated mesoporous silica particles. Lipid-coated mesoporous silica particles may comprise a mesoporous silica nanoparticle core and a lipid membrane shell. The silica core may have a large internal surface area, leading to high cargo loading capacities. In some embodiments, pore sizes, pore chemistry, and overall particle sizes may be modified for loading different types of cargos. The lipid coating of the particle may also be modified to maximize cargo loading, increase circulation times, and provide precise targeting and cargo release. Examples of lipid-coated mesoporous silica particles include those described in Du X, et al. (2014). Biomaterials 35:5580-90; Durfee P N, et al. (2016). ACS Nano 10:8325-45.

Inorganic Nanoparticles

The delivery vehicles may comprise inorganic nanoparticles. Examples of inorganic nanoparticles include carbon nanotubes (CNTs) (e.g., as described in Bates K and Kostarelos K. (2013). Adv Drug Deliv Rev 65:2023-33), bare mesoporous silica nanoparticles (MSNPs) (e.g., as described in Luo G F, et al. (2014). Sci Rep 4:6064), and dense silica nanoparticles (SiNPs) (as described in Luo D and Saltzman W M. (2000). Nat Biotechnol 18:893-5).

Exosomes

The delivery vehicles may comprise exosomes. Exosomes include membrane bound extracellular vesicles, which can be used to contain and delivery various types of biomolecules, such as proteins, carbohydrates, lipids, and nucleic acids, and complexes thereof (e.g., RNPs). Examples of exosomes include those described in Schroeder A, et al., J Intern Med. 2010 January; 267(1):9-21; El-Andaloussi S, et al., Nat Protoc. 2012 December; 7(12):2112-26; Uno Y, et al., Hum Gene Ther. 2011 June; 22(6):711-9; Zou W, et al., Hum Gene Ther. 2011 April; 22(4):465-75.

In some examples, the exosome may form a complex (e.g., by binding directly or indirectly) to one or more components of the cargo. In certain examples, a molecule of an exosome may be fused with first adapter protein and a component of the cargo may be fused with a second adapter protein. The first and the second adapter protein may specifically bind each other, thus associating the cargo with the exosome. Examples of such exosomes include those described in Ye Y, et al., Biomater Sci. 2020 Apr. 28. doi: 10.1039/d0bm00427h.

Other non-limiting, exemplary exosomes include any of those set forth in Alvarez-Erviti et al. 2011, Nat Biotechnol 29: 341; [1401] El-Andaloussi et al. (Nature Protocols 7:2112-2126(2012); and Wahlgren et al. (Nucleic Acids Research, 2012, Vol. 40, No. 17 e130).

Spherical Nucleic Acids (SNAs)

In some embodiments, the delivery vehicle can be a SNA. SNAs are three dimensional nanostructures that can be composed of densely functionalized and highly oriented nucleic acids that can be covalently attached to the surface of spherical nanoparticle cores. The core of the spherical nucleic acid can impart the conjugate with specific chemical and physical properties, and it can act as a scaffold for assembling and orienting the oligonucleotides into a dense spherical arrangement that gives rise to many of their functional properties, distinguishing them from all other forms of matter. In some embodiments, the core is a cross-linked polymer. Non-limiting, exemplary SNAs can be any of those set forth in Cutler et al., J. Am. Chem. Soc. 2011 133:9254-9257, Hao et al., Small. 2011 7:3158-3162, Zhang et al., ACS Nano. 2011 5:6962-6970, Cutler et al., J. Am. Chem. Soc. 2012 134:1376-1391, Young et al., Nano Lett. 2012 12:3867-71, Zheng et al., Proc. Natl. Acad. Sci. USA. 2012 109:11975-80, Mirkin, Nanomedicine 2012 7:635-638 Zhang et al., J. Am. Chem. Soc. 2012 134:16488-1691, Weintraub, Nature 2013 495:S14-S16, Choi et al., Proc. Natl. Acad. Sci. USA. 2013 110(19):7625-7630, Jensen et al., Sci. Transl. Med. 5, 209 ra152 (2013) and Mirkin, et al., and Small, 10:186-192.

Self-Assemblin Nanoparticles

In some embodiments, the delivery vehicle is a self-assembling nanoparticle. The self-assembling nanoparticles can contain one or more polymers. The self-assembling nanoparticles can be PEGylated. Self-assembling nanoparticles are known in the art. Non-limiting, exemplary self-assembling nanoparticles can any as set forth in Schiffelers et al., Nucleic Acids Research, 2004, Vol. 32, No. 19, Bartlett et al. (PNAS, Sep. 25, 2007, vol. 104, no. 39; Davis et al., Nature, Vol 464, 15 Apr. 2010.

Supercharged Proteins

In some embodiments, the delivery vehicle can be a supercharged protein. As used herein "Supercharged proteins" are a class of engineered or naturally occurring proteins with unusually high positive or negative net theoretical charge. Non-limiting, exemplary supercharged proteins can be any of those set forth in Lawrence et al., 2007, Journal of the American Chemical Society 129, 10110-10112.

Targeted Delivery

In some embodiments, the delivery vehicle can allow for targeted delivery to a specific cell, tissue, organ, or system. In such embodiments, the delivery vehicle can include one or more targeting moieties that can direct targeted delivery of the cargo(s). In an embodiment, the delivery vehicle comprises a targeting moiety, such as active targeting of a lipid entity of the invention, e.g., lipid particle or nanoparticle or liposome or lipid bilayer of the invention comprising a targeting moiety for active targeting.

With regard to targeting moieties, mention is made of Deshpande et al, "Current trends in the use of liposomes for tumor targeting," Nanomedicine (Lond). 8(9), doi:10.2217/nnm.13.118 (2013), and the documents it cites, all of which are incorporated herein by reference and the teachings of which can be applied and/or adapted for targeted delivery of one or more CRISPR-Cas molecules described herein. Mention is also made of International Patent Publication No. WO 2016/027264, and the documents it cites, all of which are incorporated herein by reference, the teachings of which can be applied and/or adapted for targeted delivery of one or more CRISPR-Cas molecules described herein. And mention is made of Lorenzer et al, "Going beyond the liver: Progress and challenges of targeted delivery of siRNA therapeutics," Journal of Controlled Release, 203: 1-15 (2015), and the documents it cites, all of which are incorporated herein by reference, the teachings of which can be applied and/or adapted for targeted delivery of one or more CRISPR-Cas molecules described herein.

An actively targeting lipid particle or nanoparticle or liposome or lipid bilayer delivery system (generally as to embodiments of the invention, "lipid entity of the invention" delivery systems) are prepared by conjugating targeting moieties, including small molecule ligands, peptides and monoclonal antibodies, on the lipid or liposomal surface; for example, certain receptors, such as folate and transferrin (Tf) receptors (TfR), are overexpressed on many cancer cells and have been used to make liposomes tumor cell specific.

Liposomes that accumulate in the tumor microenvironment can be subsequently endocytosed into the cells by interacting with specific cell surface receptors. To efficiently target liposomes to cells, such as cancer cells, it is useful that the targeting moiety have an affinity for a cell surface receptor and to link the targeting moiety in sufficient quantities to have optimum affinity for the cell surface receptors; and determining these embodiments are within the ambit of the skilled artisan. In the field of active targeting, there are a number of cell-, e.g., tumor-, specific targeting ligands.

Also, as to active targeting, with regard to targeting cell surface receptors such as cancer cell surface receptors, targeting ligands on liposomes can provide attachment of liposomes to cells, e.g., vascular cells, via a noninternalizing epitope; and, this can increase the extracellular concentration of that which is being delivered, thereby increasing the amount delivered to the target cells. A strategy to target cell surface receptors, such as cell surface receptors on cancer cells, such as overexpressed cell surface receptors on cancer cells, is to use receptor-specific ligands or antibodies. Many cancer cell types display upregulation of tumor-specific receptors. For example, TfRs and folate receptors (FRs) are greatly overexpressed by many tumor cell types in response to their increased metabolic demand. Folic acid can be used as a targeting ligand for specialized delivery owing to its ease of conjugation to nanocarriers, its high affinity for FRs and the relatively low frequency of FRs, in normal tissues as compared with their overexpression in activated macrophages and cancer cells, e.g., certain ovarian, breast, lung, colon, kidney and brain tumors. Overexpression of FR on macrophages is an indication of inflammatory diseases, such as psoriasis, Crohn's disease, rheumatoid arthritis and atherosclerosis; accordingly, folate-mediated targeting of the invention can also be used for studying, addressing or treating inflammatory disorders, as well as cancers. Folate-linked lipid particles or nanoparticles or liposomes or lipid bilayers of the invention ("lipid entity of the invention") deliver their cargo intracellularly through receptor-mediated endocytosis. Intracellular trafficking can be directed to acidic compartments that facilitate cargo release, and, most importantly, release of the cargo can be altered or delayed until it reaches the cytoplasm or vicinity of target organelles. Delivery of cargo using a lipid entity of the invention having a targeting moiety, such as a folate-linked lipid entity of the invention, can be superior to nontargeted lipid entity of the invention. The attachment of folate directly to the lipid head groups may not be favorable for intracellular delivery of folate-conjugated lipid entity of the invention, since they may not bind as efficiently to cells as folate attached to the lipid entity of the invention surface by a spacer, which may can enter cancer cells more efficiently. A lipid entity of the invention coupled to folate can be used for the delivery of complexes of lipid, e.g., liposome, e.g., anionic liposome and virus or capsid or envelope or virus outer protein, such as those herein discussed such as adenovirus or AAV. Tf is a monomeric serum glycoprotein of approximately 80 KDa involved in the transport of iron throughout the body. Tf binds to the TfR and translocates into cells via receptor-mediated endocytosis. The expression of TfR is can be higher in certain cells, such as tumor cells (as compared with normal cells and is associated with the increased iron demand in rapidly proliferating cancer cells. Accordingly, the invention comprehends a TfR-targeted lipid entity of the invention, e.g., as to liver cells, liver cancer, breast cells such as breast cancer cells, colon such as colon cancer cells, ovarian cells such as ovarian cancer cells, head, neck and lung cells, such as head, neck and non-small-cell lung cancer cells, cells of the mouth such as oral tumor cells.

Also, as to active targeting, a lipid entity of the invention can be multifunctional, i.e., employ more than one targeting moiety such as CPP, along with Tf; a bifunctional system; e.g., a combination of Tf and poly-L-arginine which can provide transport across the endothelium of the blood-brain barrier. EGFR, is a tyrosine kinase receptor belonging to the ErbB family of receptors that mediates cell growth, differentiation and repair in cells, especially non-cancerous cells, but EGF is overexpressed in certain cells such as many solid tumors, including colorectal, non-small-cell lung cancer, squamous cell carcinoma of the ovary, kidney, head, pancreas, neck and prostate, and especially breast cancer. The invention comprehends EGFR-targeted monoclonal antibody(ies) linked to a lipid entity of the invention. HER-2 is often overexpressed in patients with breast cancer, and is also associated with lung, bladder, prostate, brain and stomach cancers. HER-2, encoded by the ERBB2 gene. The invention comprehends a HER-2-targeting lipid entity of the invention, e.g., an anti-HER-2-antibody (or binding fragment thereof)-lipid entity of the invention, a HER-2-targeting-PEGylated lipid entity of the invention (e.g., having an anti-HER-2-antibody or binding fragment thereof), a HER-2-targeting-maleimide-PEG polymer-lipid entity of the invention (e.g., having an anti-HER-2-antibody or binding fragment thereof). Upon cellular association, the receptor-antibody complex can be internalized by formation of an endosome for delivery to the cytoplasm.

With respect to receptor-mediated targeting, the skilled artisan takes into consideration ligand/target affinity and the quantity of receptors on the cell surface, and that PEGylation can act as a barrier against interaction with receptors. The use of antibody-lipid entity of the invention targeting can be advantageous. Multivalent presentation of targeting moieties can also increase the uptake and signaling properties of antibody fragments. In practice of the invention, the skilled person takes into account ligand density (e.g., high ligand densities on a lipid entity of the invention may be advantageous for increased binding to target cells). Preventing early by macrophages can be addressed with a sterically stabilized lipid entity of the invention and linking ligands to the terminus of molecules such as PEG, which is anchored in the lipid entity of the invention (e.g., lipid particle or nanoparticle or liposome or lipid bilayer). The microenvironment of a cell mass such as a tumor microenvironment can be targeted; for instance, it may be advantageous to target cell mass vasculature, such as the tumor vasculature microenvironment. Thus, the invention comprehends targeting VEGF. VEGF and its receptors are well-known proangiogenic molecules and are well-characterized targets for antiangiogenic therapy. Many small-molecule inhibitors of receptor tyrosine kinases, such as VEGFRs or basic FGFRs, have been developed as anticancer agents and the invention comprehends coupling any one or more of these peptides to a lipid entity of the invention, e.g., phage IVO peptide(s) (e.g., via or with a PEG terminus), tumor-homing peptide APRPG such as APRPG-PEG-modified. VCAM, the vascular endothelium plays a key role in the pathogenesis of inflammation, thrombosis and atherosclerosis. CAMs are involved in inflammatory disorders, including cancer, and are a logical target, E- and P-selectins, VCAM-1 and ICAMs. Can be used to target a lipid entity of the invention, e.g., with PEGylation.

Matrix metalloproteases (MMPs) belong to the family of zinc-dependent endopeptidases. They are involved in tissue remodeling, tumor invasiveness, resistance to apoptosis and metastasis. There are four MMP inhibitors called TIMP1-4, which determine the balance between tumor growth inhibition and metastasis; a protein involved in the angiogenesis of tumor vessels is MT 1-MMP, expressed on newly formed vessels and tumor tissues. The proteolytic activity of MT1-MMP cleaves proteins, such as fibronectin, elastin, collagen and laminin, at the plasma membrane and activates soluble MMPs, such as MMP-2, which degrades the matrix. An antibody or fragment thereof such as a Fab' fragment can be used in the practice of the invention such as for an antihuman MT1-MMP monoclonal antibody linked to a lipid entity of the invention, e.g., via a spacer such as a PEG spacer. αβ-integrins or integrins are a group of transmembrane glycoprotein receptors that mediate attachment between a cell and its surrounding tissues or extracellular matrix.

Integrins contain two distinct chains (heterodimers) called α- and β-subunits. The tumor tissue-specific expression of integrin receptors can be been utilized for targeted delivery in the invention, e.g., whereby the targeting moiety can be an RGD peptide such as a cyclic RGD.

Aptamers are ssDNA or RNA oligonucleotides that impart high affinity and specific recognition of the target molecules by electrostatic interactions, hydrogen bonding and hydrophobic interactions as opposed to the Watson-Crick base pairing, which is typical for the bonding interactions of oligonucleotides. Aptamers as a targeting moiety can have advantages over antibodies: aptamers can demonstrate higher target antigen recognition as compared with antibodies; aptamers can be more stable and smaller in size as compared with antibodies; aptamers can be easily synthesized and chemically modified for molecular conjugation; and aptamers can be changed in sequence for improved selectivity and can be developed to recognize poorly immunogenic targets. Such moieties as a sgc8 aptamer can be used as a targeting moiety (e.g., via covalent linking to the lipid entity of the invention, e.g., via a spacer, such as a PEG spacer).

Also, as to active targeting, the invention also comprehends intracellular delivery. Since liposomes follow the endocytic pathway, they are entrapped in the endosomes (pH 6.5-6) and subsequently fuse with lysosomes (pH<5), where they undergo degradation that results in a lower therapeutic potential. The low endosomal pH can be taken advantage of to escape degradation. Fusogenic lipids or peptides, which destabilize the endosomal membrane after the conformational transition/activation at a lowered pH. Amines are protonated at an acidic pH and cause endosomal swelling and rupture by a buffer effect Unsaturated dioleoylphosphatidylethanolamine (DOPE) readily adopts an inverted hexagonal shape at a low pH, which causes fusion of liposomes to the endosomal membrane. This process destabilizes a lipid entity containing DOPE and releases the cargo into the cytoplasm; fusogenic lipid GALA, cholesteryl-GALA and PEG-GALA may show a highly efficient endosomal release; a pore-forming protein listeriolysin O may provide an endosomal escape mechanism; and, histidine-rich peptides have the ability to fuse with the endosomal membrane, resulting in pore formation, and can buffer the proton pump causing membrane lysis.

The invention comprehends a lipid entity of the invention modified with CPP(s), for intracellular delivery that may proceed via energy dependent macropinocytosis followed by endosomal escape. The invention further comprehends organelle-specific targeting. A lipid entity of the invention surface-functionalized with the triphenylphosphonium (TPP) moiety or a lipid entity of the invention with a lipophilic cation, rhodamine 123 can be effective in delivery of cargo to mitochondria. DOPE/sphingomyelin/stearyl-octa-arginine can delivers cargos to the mitochondrial interior via membrane fusion. A lipid entity of the invention surface modified with a lysosomotropic ligand, octadecyl rhodamine B can deliver cargo to lysosomes. Ceramides are useful in inducing lysosomal membrane permeabilization; the invention comprehends intracellular delivery of a lipid entity of the invention having a ceramide. The invention further comprehends a lipid entity of the invention targeting the nucleus, e.g., via a DNA-intercalating moiety. The invention also comprehends multifunctional liposomes for targeting, i.e., attaching more than one functional group to the surface of the lipid entity of the invention, for instance to enhances accumulation in a desired site and/or promotes organelle-specific delivery and/or target a particular type of cell and/or respond to the local stimuli such as temperature (e.g., elevated), pH (e.g., decreased), respond to externally applied stimuli such as a magnetic field, light, energy, heat or ultrasound and/or promote intracellular delivery of the cargo. All of these are considered actively targeting moieties.

It should be understood that as to each possible targeting or active targeting moiety herein discussed, there is an embodiment of the invention wherein the delivery system comprises such a targeting or active targeting moiety. Likewise, Table 10 provides exemplary targeting moieties that can be used in the practice of the invention an as to each an embodiment of the invention provides a delivery system that comprises such a targeting moiety.

TABLE 10

| Targeting Moiety | Target Molecule | Target Cell or Tissue |
| --- | --- | --- |
| folate | folate receptor | cancer cells |
| transferrin | transferrin receptor | cancer cells |
| Antibody CC52 | rat CC531 | rat colon adenocarcinoma CC531 |
| anti- HER2 antibody | HER2 | HER2 -overexpressing tumors |
| anti-GD2 | GD2 | neuroblastoma, melanoma |
| anti-EGFR | EGFR | tumor cells overexpressing EGFR |
| pH-dependent fusogenic peptide diINF-7 | | ovarian carcinoma |
| anti-VEGFR | VEGF Receptor | tumor vasculature |
| anti-CD19 | CD19 (B cell marker) | leukemia, lymphoma |
| cell-penetrating peptide | | blood-brain barrier |
| cyclic arginine-glycine-aspartic acid-tyrosine-cysteine peptide (c(RGDyC)-LP) | avβ3 | glioblastoma cells, human umbilical vein endothelial cells, tumor angiogenesis |

TABLE 10-continued

| Targeting Moiety | Target Molecule | Target Cell or Tissue |
| --- | --- | --- |
| ASSHN peptide (SEQ ID NO: 134) | | endothelial progenitor cells; anti-cancer |
| PR_b peptide | $\alpha_5\beta_1$ integrin | cancer cells |
| AG86 peptide | $\alpha_6\beta_4$ integrin | cancer cells |
| KCCYSL (SEQ ID NO: 28) (P6.1 peptide) | HER-2 receptor | cancer cells |
| affinity peptide LN (YEVGHRC) (SEQ ID NO: 29) | Aminopeptidase N (APN/CD13) | APN-positive tumor |
| synthetic somatostatin analogue | Somatostatin receptor 2 (SSTR2) | breast cancer |
| anti-CD20 monoclonal antibody | B-lymphocytes | B cell lymphoma |

Thus, in an embodiment of the delivery system, the targeting moiety comprises a receptor ligand, such as, for example, hyaluronic acid for CD44 receptor, galactose for hepatocytes, or antibody or fragment thereof such as a binding antibody fragment against a desired surface receptor, and as to each of a targeting moiety comprising a receptor ligand, or an antibody or fragment thereof such as a binding fragment thereof, such as against a desired surface receptor, there is an embodiment of the invention wherein the delivery system comprises a targeting moiety comprising a receptor ligand, or an antibody or fragment thereof such as a binding fragment thereof, such as against a desired surface receptor, or hyaluronic acid for CD44 receptor, galactose for hepatocytes (see, e.g., Surace et al, "Lipoplexes targeting the CD44 hyaluronic acid receptor for efficient transfection of breast cancer cells," J. Mol Pharm 6(4):1062-73; doi: 10.1021/mp800215d (2009); Sonoke et al, "Galactose-modified cationic liposomes as a liver-targeting delivery system for small interfering RNA," Biol Pharm Bull. 34(8): 1338-42 (2011); Torchilin, "Antibody-modified liposomes for cancer chemotherapy," Expert Opin. Drug Deliv. 5 (9), 1003-1025 (2008); Manjappa et al, "Antibody derivatization and conjugation strategies: application in preparation of stealth immunoliposome to target chemotherapeutics to tumor," J. Control. Release 150 (1), 2-22 (2011); Sofou S "Antibody-targeted liposomes in cancer therapy and imaging," Expert Opin. Drug Deliv. 5 (2): 189-204 (2008); Gao J et al, "Antibody-targeted immunoliposomes for cancer treatment," Mini. Rev. Med. Chem. 13(14): 2026-2035 (2013); Molavi et al, "Anti-CD30 antibody conjugated liposomal doxorubicin with significantly improved therapeutic efficacy against anaplastic large cell lymphoma," Biomaterials 34(34):8718-25 (2013), each of which and the documents cited therein are hereby incorporated herein by reference), the teachings of which can be applied and/or adapted for targeted delivery of one or more CRISPR-Cas molecules described herein.

Other exemplary targeting moieties are described elsewhere herein, such as epitope tags and the like.

Responsive Delivery

In some embodiments, the delivery vehicle can allow for responsive delivery of the cargo(s). Responsive delivery, as used in this context herein, refers to delivery of cargo(s) by the delivery vehicle in response to an external stimuli. Examples of suitable stimuli include, without limitation, an energy (light, heat, cold, and the like), a chemical stimuli (e.g., chemical composition, etc.), and a biologic or physiologic stimuli (e.g., environmental pH, osmolarity, salinity, biologic molecule, etc.). In some embodiments, the targeting moiety can be responsive to an external stimuli and facilitate responsive delivery. In other embodiments, responsiveness is determined by a non-targeting moiety component of the delivery vehicle.

The delivery vehicle can be stimuli-sensitive, e.g., sensitive to an externally applied stimuli, such as magnetic fields, ultrasound or light; and pH-triggering can also be used, e.g., a labile linkage can be used between a hydrophilic moiety such as PEG and a hydrophobic moiety such as a lipid entity of the invention, which is cleaved only upon exposure to the relatively acidic conditions characteristic of a particular environment or microenvironment such as an endocytic vacuole or the acidotic tumor mass. pH-sensitive copolymers can also be incorporated in embodiments of the invention can provide shielding; diortho esters, vinyl esters, cysteine-cleavable lipopolymers, double esters and hydrazones are a few examples of pH-sensitive bonds that are quite stable at pH 7.5, but are hydrolyzed relatively rapidly at pH 6 and below, e.g., a terminally alkylated copolymer of N-isopropylacrylamide and methacrylic acid that copolymer facilitates destabilization of a lipid entity of the invention and release in compartments with decreased pH value; or, the invention comprehends ionic polymers for generation of a pH-responsive lipid entity of the invention (e.g., poly (methacrylic acid), poly(diethylaminoethyl methacrylate), poly(acrylamide) and poly(acrylic acid)).

Temperature-triggered delivery is also within the ambit of the invention. Many pathological areas, such as inflamed tissues and tumors, show a distinctive hyperthermia compared with normal tissues. Utilizing this hyperthermia is an attractive strategy in cancer therapy since hyperthermia is associated with increased tumor permeability and enhanced uptake. This technique involves local heating of the site to increase microvascular pore size and blood flow, which, in turn, can result in an increased extravasation of embodiments of the invention. Temperature-sensitive lipid entity of the invention can be prepared from thermosensitive lipids or polymers with a low critical solution temperature. Above the low critical solution temperature (e.g., at site such as tumor site or inflamed tissue site), the polymer precipitates, disrupting the liposomes to release. Lipids with a specific gel-to-liquid phase transition temperature are used to prepare these lipid entities of the invention; and a lipid for a thermosensitive embodiment can be dipalmitoylphosphatidylcholine. Thermosensitive polymers can also facilitate destabilization followed by release, and a useful thermosensitive polymer is poly (N-isopropylacrylamide). Another temperature triggered system can employ lysolipid temperature-sensitive liposomes.

The invention also comprehends redox-triggered delivery. The difference in redox potential between normal and inflamed or tumor tissues, and between the intra- and extra-cellular environments has been exploited for delivery, e.g., GSH is a reducing agent abundant in cells, especially in the cytosol, mitochondria and nucleus. The GSH concentrations in blood and extracellular matrix are just one out of 100 to one out of 1000 of the intracellular concentration, respectively. This high redox potential difference caused by GSH, cysteine and other reducing agents can break the reducible bonds, destabilize a lipid entity of the invention and result in release of payload. The disulfide bond can be used as the cleavable/reversible linker in a lipid entity of the invention, because it causes sensitivity to redox owing to the disulfideto-thiol reduction reaction; a lipid entity of the invention can be made reduction sensitive by using two (e.g., two forms of a disulfide-conjugated multifunctional lipid as cleavage of the disulfide bond (e.g., via tris(2-carboxyethyl) phosphine, dithiothreitol, L-cysteine or GSH), can cause removal of the hydrophilic head group of the conjugate and alter the membrane organization leading to release of payload. Calcein release from reduction-sensitive lipid entity of the invention containing a disulfide conjugate can be more useful than a reduction-insensitive embodiment.

Enzymes can also be used as a trigger to release payload. Enzymes, including MMPs (e.g. MMP2), phospholipase A2, alkaline phosphatase, transglutaminase or phosphatidylinositol-specific phospholipase C, have been found to be overexpressed in certain tissues, e.g., tumor tissues. In the presence of these enzymes, specially engineered enzyme-sensitive lipid entity of the invention can be disrupted and release the payload. an MMP2-cleavable octapeptide (Gly-Pro-Leu-Gly-Ile-Ala-Gly-Gln) (SEQ ID NO: 30) can be incorporated into a linker, and can have antibody targeting, e.g., antibody 2C5.

The invention also comprehends light- or energy-triggered delivery, e.g., the lipid entity of the invention can be light-sensitive, such that light or energy can facilitate structural and conformational changes, which lead to direct interaction of the lipid entity of the invention with the target cells via membrane fusion, photo-isomerism, photofragmentation or photopolymerization; such a moiety therefor can be benzoporphyrin photosensitizer. Ultrasound can be a form of energy to trigger delivery; a lipid entity of the invention with a small quantity of particular gas, including air or perfluorinated hydrocarbon can be triggered to release with ultrasound, e.g., low-frequency ultrasound (LFUS). Magnetic delivery: A lipid entity of the invention can be magnetized by incorporation of magnetites, such as Fe304 or γ-Fe203, e.g., those that are less than 10 nm in size. Targeted delivery can be then by exposure to a magnetic field.

Pharmaceutical Formulations

Also described herein are pharmaceutical formulations that can contain an amount, effective amount, and/or least effective amount, and/or therapeutically effective amount of one or more compounds, molecules, compositions, vectors, vector systems, cells, or a combination thereof (which are also referred to as the primary active agent or ingredient elsewhere herein) described in greater detail elsewhere herein a pharmaceutically acceptable carrier or excipient. As used herein, "pharmaceutical formulation" refers to the combination of an active agent, compound, or ingredient with a pharmaceutically acceptable carrier or excipient, making the composition suitable for diagnostic, therapeutic, or preventive use in vitro, in vivo, or ex vivo. As used herein, "pharmaceutically acceptable carrier or excipient" refers to a carrier or excipient that is useful in preparing a pharmaceutical formulation that is generally safe, non-toxic, and is neither biologically or otherwise undesirable, and includes a carrier or excipient that is acceptable for veterinary use as well as human pharmaceutical use. A "pharmaceutically acceptable carrier or excipient" as used in the specification and claims includes both one and more than one such carrier or excipient. When present, the compound can optionally be present in the pharmaceutical formulation as a pharmaceutically acceptable salt. In some embodiments, the pharmaceutical formulation can include, such as an active ingredient, a CRISPR-Cas system or component thereof described in greater detail elsewhere herein. In some embodiments, the pharmaceutical formulation can include, such as an active ingredient, a CRISPR-Cas polynucleotide described in greater detail elsewhere herein. In some embodiments, the pharmaceutical formulation can include, such as an active ingredient one or more modified cells, such as one or more modified cells described in greater detail elsewhere herein.

In some embodiments, the active ingredient is present as a pharmaceutically acceptable salt of the active ingredient. As used herein, "pharmaceutically acceptable salt" refers to any acid or base addition salt whose counter-ions are non-toxic to the subject to which they are administered in pharmaceutical doses of the salts. Suitable salts include, hydrobromide, iodide, nitrate, bisulfate, phosphate, isonicotinate, lactate, salicylate, acid citrate, tartrate, oleate, tannate, pantothenate, bitartrate, ascorbate, succinate, maleate, gentisinate, fumarate, gluconate, glucuronate, saccharate, formate, benzoate, glutamate, methanesulfonate, ethanesulfonate, benzenesulfonate, p-toluenesulfonate, camphorsulfonate, naphthalenesulfonate, propionate, malonate, mandelate, malate, phthalate, and pamoate.

The pharmaceutical formulations described herein can be administered to a subject in need thereof via any suitable method or route to a subject in need thereof. Suitable administration routes can include, but are not limited to auricular (otic), buccal, conjunctival, cutaneous, dental, electro-osmosis, endocervical, endosinusial, endotracheal, enteral, epidural, extra-amniotic, extracorporeal, hemodialysis, infiltration, interstitial, intra-abdominal, intra-amniotic, intra-arterial, intra-articular, intrabiliary, intrabronchial, intrabursal, intracardiac, intracartilaginous, intracaudal, intracavernous, intracavitary, intracerebral, intracisternal, intracorneal, intracoronal (dental), intracoronary, intracorporus cavernosum, intradermal, intradiscal, intraductal, intraduodenal, intradural, intraepidermal, intraesophageal, intragastric, intragingival, intraileal, intralesional, intraluminal, intralymphatic, intramedullary, intrameningeal, intramuscular, intraocular, intraovarian, intrapericardial, intraperitoneal, intrapleural, intraprostatic, intrapulmonary, intrasinal, intraspinal, intrasynovial, intratendinous, intratesticular, intrathecal, intrathoracic, intratubular, intratumor, intratympanic, intrauterine, intravascular, intravenous, intravenous bolus, intravenous drip, intraventricular, intravesical, intravitreal, iontophoresis, irrigation, laryngeal, nasal, nasogastric, occlusive dressing technique, ophthalmic, oral, oropharyngeal, other, parenteral, percutaneous, periarticular, peridural, perineural, periodontal, rectal, respiratory (inhalation), retrobulbar, soft tissue, subarachnoid, subconjunctival, subcutaneous, sublingual, submucosal, topical, transdermal, transmucosal, transplacental, transtracheal, transtympanic, ureteral, urethral, and/or vaginal administration, and/or any combination of the above administration routes, which typically depends on the disease to be treated and/or the active ingredient(s).

Where appropriate, compounds, molecules, compositions, vectors, vector systems, cells, or a combination thereof described in greater detail elsewhere herein can be provided to a subject in need thereof as an ingredient, such as an active ingredient or agent, in a pharmaceutical formulation. As such, also described are pharmaceutical formulations containing one or more of the compounds and salts thereof, or pharmaceutically acceptable salts thereof described herein. Suitable salts include, hydrobromide, iodide, nitrate, bisulfate, phosphate, isonicotinate, lactate, salicylate, acid citrate, tartrate, oleate, tannate, pantothenate, bitartrate, ascorbate, succinate, maleate, gentisinate, fumarate, gluconate, glucuronate, saccharate, formate, benzoate, glutamate, methanesulfonate, ethanesulfonate, benzenesulfonate, p-toluenesulfonate, camphorsulfonate, naphthalenesulfonate, propionate, malonate, mandelate, malate, phthalate, and pamoate.

In some embodiments, the subject in need thereof has or is suspected of having a hematopoietic disease or a symptom thereof. Exemplary diseases are described in greater detail elsewhere herein, such as in connection with therapeutic methods. As used herein, "agent" refers to any substance, compound, molecule, and the like, which can be biologically active or otherwise can induce a biological and/or physiological effect on a subject to which it is administered to. As used herein, "active agent" or "active ingredient" refers to a substance, compound, or molecule, which is biologically active or otherwise, induces a biological or physiological effect on a subject to which it is administered to. In other words, "active agent" or "active ingredient" refers to a component or components of a composition to which the whole or part of the effect of the composition is attributed. An agent can be a primary active agent, or in other words, the component(s) of a composition to which the whole or part of the effect of the composition is attributed. An agent can be a secondary agent, or in other words, the component(s) of a composition to which an additional part and/or other effect of the composition is attributed.

Pharmaceutically Acceptable Carriers and Secondary Ingredients and Agents

The pharmaceutical formulation can include a pharmaceutically acceptable carrier. Suitable pharmaceutically acceptable carriers include, but are not limited to water, salt solutions, alcohols, gum arabic, vegetable oils, benzyl alcohols, polyethylene glycols, gelatin, carbohydrates such as lactose, amylose or starch, magnesium stearate, talc, silicic acid, viscous paraffin, perfume oil, fatty acid esters, hydroxy methylcellulose, and polyvinyl pyrrolidone, which do not deleteriously react with the active composition.

The pharmaceutical formulations can be sterilized, and if desired, mixed with agents, such as lubricants, preservatives, stabilizers, wetting agents, emulsifiers, salts for influencing osmotic pressure, buffers, coloring, flavoring and/or aromatic substances, and the like which do not deleteriously react with the active compound.

In some embodiments, the pharmaceutical formulation can also include an effective amount of secondary active agents, including but not limited to, biologic agents or molecules including, but not limited to, e.g. polynucleotides, amino acids, peptides, polypeptides, antibodies, aptamers, ribozymes, hormones, immunomodulators, antipyretics, anxiolytics, antipsychotics, analgesics, antispasmodics, anti-inflammatories, anti-histamines, anti-infectives, chemotherapeutics, imagining agents, sensitizers, and combinations thereof.

Effective Amounts

In some embodiments, the amount of the primary active agent and/or optional secondary agent can be an effective amount, least effective amount, and/or therapeutically effective amount. As used herein, "effective amount" refers to the amount of the primary and/or optional secondary agent included in the pharmaceutical formulation that achieve one or more therapeutic effects or desired effect. As used herein, "least effective" amount refers to the lowest amount of the primary and/or optional secondary agent that achieves the one or more therapeutic or other desired effects. As used herein, "therapeutically effective amount" refers to the amount of the primary and/or optional secondary agent included in the pharmaceutical formulation that achieves one or more therapeutic effects. In some embodiments, the one or more therapeutic effects are to modify a nucleic acid in vitro, ex vivo, in situ, or in vivo.

The effective amount, least effective amount, and/or therapeutically effective amount of the primary and optional secondary active agent described elsewhere herein contained in the pharmaceutical formulation can range from about 0 to 10, 20, 30, 40, 50, 60, 70, 80, 90, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, 1000 pg, ng, g, mg, or g or be any numerical value with any of these ranges.

In some embodiments, the effective amount, least effective amount, and/or therapeutically effective amount can be an effective concentration, least effective concentration, and/or therapeutically effective concentration, which can each range from about 0 to 10, 20, 30, 40, 50, 60, 70, 80, 90, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, 1000 pM, nM, M, mM, or M or be any numerical value with any of these ranges.

In other embodiments, the effective amount, least effective amount, and/or therapeutically effective amount of the primary and optional secondary active agent can range from about 0 to 10, 20, 30, 40, 50, 60, 70, 80, 90, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, 1000 IU or be any numerical value with any of these ranges.

In some embodiments, the primary and/or the optional secondary active agent present in the pharmaceutical formulation can range from about 0 to 0.001, 0.002, 0.003, 0.004, 0.005, 0.006, 0.007, 0.008, 0.009, 0.01, 0.02, 0.03, 0.04, 0.05, 0.06, 0.07, 0.08, 0.09, 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, 0.5, 0.51, 0.52, 0.53, 0.54, 0.55, 0.56, 0.57, 0.58, 0.59, 0.6, 0.61, 0.62, 0.63, 0.64, 0.65, 0.66, 0.67, 0.68, 0.69, 0.7, 0.71, 0.72, 0.73, 0.74, 0.75, 0.76, 0.77, 0.78, 0.79, 0.8, 0.81, 0.82, 0.83, 0.84, 0.85, 0.86, 0.87, 0.88, 0.89, 0.9, 0.91, 0.92, 0.93, 0.94, 0.95, 0.96, 0.97, 0.98, 0.9, to 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 99.1, 99.2, 99.3, 99.4, 99.5, 99.6, 99.7, 99.8, 99.9% w/w, v/v, or w/v of the pharmaceutical formulation.

In some embodiments where a cell population is present in the pharmaceutical formulation (e.g., as a primary and/or or secondary active agent), the effective amount of cells can range from about 2 cells to $1\times10^1$/mL, $1\times10^{20}$/mL or more, such as about $1\times10^1$/mL, $1\times10^2$/mL, $1\times10^3$/mL, $1\times10^4$/mL, $1\times10^5$/mL, $1\times10^6$/mL, $1\times10^7$/mL, $1\times10^8$/mL, $1\times10^9$/mL, $1\times10^{10}$/mL, $1\times10^{11}$/mL, $1\times10^{12}$/mL, $1\times10^{13}$/mL, $1\times10^{14}$/mL, $1\times10^{15}$/mL, $1\times10^{16}$/mL, $1\times10^{17}$/mL, $1\times10^{18}$/mL, $1\times10^{19}$/mL, to/or about $1\times10^{20}$/mL.

In some embodiments, the amount or effective amount, particularly where an infective particle is being delivered (e.g. a virus particle having the primary or secondary agent as a cargo), the effective amount of virus particles can be expressed as a titer (plaque forming units per unit of volume) or as a MOI (multiplicity of infection). In some embodiments, the effective amount can be $1\times10^1$ particles per pL, nL, µL, mL, or L to $1\times10^{20}$/particles per pL, nL, µL, mL, or L or more, such as about $1\times10^1$, $1\times10^2$, $1\times10^3$, $1\times10^4$, $1\times10^5$, $1\times10^6$, $1\times10^7$, $1\times10^8$, $1\times10^9$, $1\times10^{10}$, $1\times10^{11}$, $1\times10^{12}$, $1\times10^{13}$, $1\times10^{14}$, $1\times10^{15}$, $1\times10^{16}$, $1\times10^{17}$, $1\times10^{18}$, $1\times10^{19}$, to/or about $1\times10^{20}$ particles per pL, nL, µL, mL, or L. In some embodiments, the effective titer can be about $1\times10^1$ transforming units per pL, nL, µL, mL, or L to $1\times10^{20}$/transforming units per pL, nL, µL, mL, or L or more, such as about $1\times10^1$, $1\times10^2$, $1\times10^3$, $1\times10^4$, $1\times10^5$, $1\times10^6$, $1\times10^7$, $1\times10^8$, $1\times10^9$, $1\times10^{10}$, $1\times10^1$, $1\times10^{12}$, $1\times10^{13}$, $1\times10^{14}$, $1\times10^{15}$, $1\times10^{16}$, $1\times10^{17}$, $1\times10^{18}$, $1\times10^{19}$, to/or about $1\times10^{20}$ transforming units per pL, nL, µL, mL, or L. In some embodiments, the MOI of the pharmaceutical formulation can range from about 0.1 to 10 or more, such as 0.1, 0.2, 0.3, 0.4, 0.5, 0.6, 0.7, 0.8, 0.9, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, 10 or more.

In some embodiments, the amount or effective amount of the one or more of the active agent(s) described herein contained in the pharmaceutical formulation can range from about 1 pg/kg to about 10 mg/kg based upon the bodyweight of the subject in need thereof or average bodyweight of the specific patient population to which the pharmaceutical formulation can be administered.

In embodiments where there is a secondary agent contained in the pharmaceutical formulation, the effective amount of the secondary active agent will vary depending on the secondary agent, the primary agent, the administration route, subject age, disease, stage of disease, among other things, which will be one of ordinary skill in the art.

When optionally present in the pharmaceutical formulation, the secondary active agent can be included in the pharmaceutical formulation or can exist as a stand-alone compound or pharmaceutical formulation that can be administered contemporaneously or sequentially with the compound, derivative thereof, or pharmaceutical formulation thereof.

In some embodiments, the effective amount of the secondary active agent can range from about 0 to 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 99.1, 99.2, 99.3, 99.4, 99.5, 99.6, 99.7, 99.8, 99.9% w/w, v/v, or w/v of the total secondary active agent in the pharmaceutical formulation. In additional embodiments, the effective amount of the secondary active agent can range from about 0 to 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 99.1, 99.2, 99.3, 99.4, 99.5, 99.6, 99.7, 99.8, 99.9% w/w, v/v, or w/v of the total pharmaceutical formulation.

Dosage Forms

In some embodiments, the pharmaceutical formulations described herein can be provided in a dosage form. The dosage form can be administered to a subject in need thereof. The dosage form can be effective generate specific concentration, such as an effective concentration, at a given site in the subject in need thereof. As used herein, "dose," "unit dose," or "dosage" can refer to physically discrete units suitable for use in a subject, each unit containing a predetermined quantity of the primary active agent, and optionally present secondary active ingredient, and/or a pharmaceutical formulation thereof calculated to produce the desired response or responses in association with its administration. In some embodiments, the given site is proximal to the administration site. In some embodiments, the given site is distal to the administration site. In some cases, the dosage form contains a greater amount of one or more of the active ingredients present in the pharmaceutical formulation than the final intended amount needed to reach a specific region or location within the subject to account for loss of the active components such as via first and second pass metabolism.

The dosage forms can be adapted for administration by any appropriate route. Appropriate routes include, but are not limited to, oral (including buccal or sublingual), rectal, intraocular, inhaled, intranasal, topical (including buccal, sublingual, or transdermal), vaginal, parenteral, subcutaneous, intramuscular, intravenous, internasal, and intradermal. Other appropriate routes are described elsewhere herein. Such formulations can be prepared by any method known in the art.

Dosage forms adapted for oral administration can discrete dosage units such as capsules, pellets or tablets, powders or granules, solutions, or suspensions in aqueous or non-aqueous liquids; edible foams or whips, or in oil-in-water liquid emulsions or water-in-oil liquid emulsions. In some embodiments, the pharmaceutical formulations adapted for oral administration also include one or more agents which flavor, preserve, color, or help disperse the pharmaceutical formulation. Dosage forms prepared for oral administration can also be in the form of a liquid solution that can be delivered as a foam, spray, or liquid solution. The oral dosage form can be administered to a subject in need thereof. Where appropriate, the dosage forms described herein can be microencapsulated.

The dosage form can also be prepared to prolong or sustain the release of any ingredient. In some embodiments, compounds, molecules, compositions, vectors, vector systems, cells, or a combination thereof described herein can be the ingredient whose release is delayed. In some embodiments the primary active agent is the ingredient whose release is delayed. In some embodiments, an optional secondary agent can be the ingredient whose release is delayed. Suitable methods for delaying the release of an ingredient include, but are not limited to, coating or embedding the ingredients in material in polymers, wax, gels, and the like. Delayed release dosage formulations can be prepared as described in standard references such as "Pharmaceutical dosage form tablets," eds. Liberman et. al. (New York, Marcel Dekker, Inc., 1989), "Remington—The science and practice of pharmacy", 20th ed., Lippincott Williams & Wlkins, Baltimore, MD, 2000, and "Pharmaceutical dosage forms and drug delivery systems", 6th Edition, Ansel et al., (Media, PA: Williams and Wilkins, 1995). These references provide information on excipients, materials, equipment, and processes for preparing tablets and capsules and delayed release dosage forms of tablets and pellets, capsules, and granules. The delayed release can be anywhere from about an hour to about 3 months or more.

Examples of suitable coating materials include, but are not limited to, cellulose polymers such as cellulose acetate phthalate, hydroxypropyl cellulose, hydroxypropyl methylcellulose, hydroxypropyl methylcellulose phthalate, and hydroxypropyl methylcellulose acetate succinate; polyvinyl acetate phthalate, acrylic acid polymers and copolymers, and methacrylic resins that are commercially available under the trade name EUDRAGIT® (Roth Pharma, Westerstadt, Germany), zein, shellac, and polysaccharides.

Coatings may be formed with a different ratio of water-soluble polymer, water insoluble polymers, and/or pH dependent polymers, with or without water insoluble/water soluble non-polymeric excipient, to produce the desired release profile. The coating is either performed on the dosage form (matrix or simple) which includes, but is not limited to, tablets (compressed with or without coated beads), capsules (with or without coated beads), beads, particle compositions, "ingredient as is" formulated as, but not limited to, suspension form or as a sprinkle dosage form.

Where appropriate, the dosage forms described herein can be a liposome. In these embodiments, primary active ingredient(s), and/or optional secondary active ingredient(s), and/or pharmaceutically acceptable salt thereof where appropriate are incorporated into a liposome. In embodiments where the dosage form is a liposome, the pharmaceutical formulation is thus a liposomal formulation. The liposomal formulation can be administered to a subject in need thereof.

Dosage forms adapted for topical administration can be formulated as ointments, creams, suspensions, lotions, powders, solutions, pastes, gels, sprays, aerosols, or oils. In some embodiments for treatments of the eye or other external tissues, for example the mouth or the skin, the pharmaceutical formulations are applied as a topical ointment or cream. When formulated in an ointment, a primary active ingredient, optional secondary active ingredient, and/or pharmaceutically acceptable salt thereof where appropriate can be formulated with a paraffinic or water-miscible ointment base. In other embodiments, the primary and/or secondary active ingredient can be formulated in a cream with an oil-in-water cream base or a water-in-oil base. Dosage forms adapted for topical administration in the mouth include lozenges, pastilles, and mouth washes.

Dosage forms adapted for nasal or inhalation administration include aerosols, solutions, suspension drops, gels, or dry powders. In some embodiments, a primary active ingredient, optional secondary active ingredient, and/or pharmaceutically acceptable salt thereof where appropriate can be in a dosage form adapted for inhalation is in a particle-size-reduced form that is obtained or obtainable by microniza-tion. In some embodiments, the particle size of the size reduced (e.g. micronized) compound or salt or solvate thereof, is defined by a $D_{50}$ value of about 0.5 to about 10 microns as measured by an appropriate method known in the art. Dosage forms adapted for administration by inhalation also include particle dusts or mists. Suitable dosage forms wherein the carrier or excipient is a liquid for administration as a nasal spray or drops include aqueous or oil solutions/suspensions of an active (primary and/or secondary) ingredient, which may be generated by various types of metered dose pressurized aerosols, nebulizers, or insufflators. The nasal/inhalation formulations can be administered to a subject in need thereof.

In some embodiments, the dosage forms are aerosol formulations suitable for administration by inhalation. In some of these embodiments, the aerosol formulation contains a solution or fine suspension of a primary active ingredient, secondary active ingredient, and/or pharmaceutically acceptable salt thereof where appropriate and a pharmaceutically acceptable aqueous or non-aqueous solvent. Aerosol formulations can be presented in single or multi-dose quantities in sterile form in a sealed container. For some of these embodiments, the sealed container is a single dose or multi-dose nasal or an aerosol dispenser fitted with a metering valve (e.g. metered dose inhaler), which is intended for disposal once the contents of the container have been exhausted.

Where the aerosol dosage form is contained in an aerosol dispenser, the dispenser contains a suitable propellant under pressure, such as compressed air, carbon dioxide, or an organic propellant, including but not limited to a hydrofluorocarbon. The aerosol formulation dosage forms in other embodiments are contained in a pump-atomizer. The pressurized aerosol formulation can also contain a solution or a suspension of a primary active ingredient, optional secondary active ingredient, and/or pharmaceutically acceptable salt thereof. In further embodiments, the aerosol formulation also contains co-solvents and/or modifiers incorporated to improve, for example, the stability and/or taste and/or fine particle mass characteristics (amount and/or profile) of the formulation. Administration of the aerosol formulation can be once daily or several times daily, for example 2, 3, 4, or 8 times daily, in which 1, 2, 3 or more doses are delivered each time. The aerosol formulations can be administered to a subject in need thereof.

For some dosage forms suitable and/or adapted for inhaled administration, the pharmaceutical formulation is a dry powder inhalable-formulations. In addition to a primary active agent, optional secondary active ingredient, and/or pharmaceutically acceptable salt thereof where appropriate, such a dosage form can contain a powder base such as lactose, glucose, trehalose, mannitol, and/or starch. In some of these embodiments, a primary active agent, secondary active ingredient, and/or pharmaceutically acceptable salt thereof where appropriate is in a particle-size reduced form. In further embodiments, a performance modifier, such as L-leucine or another amino acid, cellobiose octaacetate, and/or metals salts of stearic acid, such as magnesium or calcium stearate. In some embodiments, the aerosol formulations are arranged so that each metered dose of aerosol contains a predetermined amount of an active ingredient, such as the one or more of the compositions, compounds, vector(s), molecules, cells, and combinations thereof described herein.

Dosage forms adapted for vaginal administration can be presented as pessaries, tampons, creams, gels, pastes, foams, or spray formulations. Dosage forms adapted for rectal administration include suppositories or enemas. The vaginal formulations can be administered to a subject in need thereof.

Dosage forms adapted for parenteral administration and/or adapted for injection can include aqueous and/or non-aqueous sterile injection solutions, which can contain antioxidants, buffers, bacteriostats, solutes that render the composition isotonic with the blood of the subject, and aqueous and non-aqueous sterile suspensions, which can include suspending agents and thickening agents. The dosage forms adapted for parenteral administration can be presented in a single-unit dose or multi-unit dose containers, including but not limited to sealed ampoules or vials. The doses can be lyophilized and re-suspended in a sterile carrier to reconstitute the dose prior to administration. Extemporaneous injection solutions and suspensions can be prepared in some embodiments, from sterile powders, granules, and tablets. The parenteral formulations can be administered to a subject in need thereof.

For some embodiments, the dosage form contains a predetermined amount of a primary active agent, secondary active ingredient, and/or pharmaceutically acceptable salt thereof where appropriate per unit dose. In an embodiment, the predetermined amount of primary active agent, secondary active ingredient, and/or pharmaceutically acceptable salt thereof where appropriate can be an effective amount, a least effect amount, and/or a therapeutically effective amount. In other embodiments, the predetermined amount of a primary active agent, secondary active agent, and/or pharmaceutically acceptable salt thereof where appropriate, can be an appropriate fraction of the effective amount of the active ingredient.

Co-Therapies and Combination Therapies

In some embodiments, the pharmaceutical formulation(s) described herein can be part of a combination treatment or combination therapy. The combination treatment can include the pharmaceutical formulation described herein and an additional treatment modality. The additional treatment modality can be a chemotherapeutic, a biological therapeutic, surgery, radiation, diet modulation, environmental modulation, a physical activity modulation, and combinations thereof.

In some embodiments, the co-therapy or combination therapy can additionally include but not limited to, polynucleotides, amino acids, peptides, polypeptides, antibodies, aptamers, ribozymes, hormones, immunomodulators, antipyretics, anxiolytics, antipsychotics, analgesics, antispasmodics, anti-inflammatories, anti-histamines, anti-infectives, chemotherapeutics, imaging agents, sensitizers, and combinations thereof.

Administration of the Pharmaceutical Formulations

The pharmaceutical formulations or dosage forms thereof described herein can be administered one or more times hourly, daily, monthly, or yearly (e.g., 1, 2, 3, 4, 5, 6, 7, 8, 9, 10, 11, 12, 13, 14, 15, 16, 17, 18, 19, 20, or more times hourly, daily, monthly, or yearly). In some embodiments, the pharmaceutical formulations or dosage forms thereof described herein can be administered continuously over a period of time ranging from minutes to hours to days. Devices and dosages forms are known in the art and described herein that are effective to provide continuous administration of the pharmaceutical formulations described herein. In some embodiments, the first one or a few initial amount(s) administered can be a higher dose than subsequent doses. This is typically referred to in the art as a loading dose or doses and a maintenance dose, respectively. In some embodiments, the pharmaceutical formulations can be administered such that the doses over time are tapered (increased or decreased) overtime so as to wean a subject gradually off of a pharmaceutical formulation or gradually introduce a subject to the pharmaceutical formulation.

As previously discussed, the pharmaceutical formulation can contain a predetermined amount of a primary active agent, secondary active agent, and/or pharmaceutically acceptable salt thereof where appropriate. In some of these embodiments, the predetermined amount can be an appropriate fraction of the effective amount of the active ingredient. Such unit doses may therefore be administered once or more than once a day, month, or year (e.g., 1, 2, 3, 4, 5, 6, or more times per day, month, or year). Such pharmaceutical formulations may be prepared by any of the methods well known in the art.

Where co-therapies or multiple pharmaceutical formulations are to be delivered to a subject, the different therapies or formulations can be administered sequentially or simultaneously. Sequential administration is administration where an appreciable amount of time occurs between administrations, such as more than about 15, 20, 30, 45, 60 minutes or more. The time between administrations in sequential administration can be on the order of hours, days, months, or even years, depending on the active agent present in each administration. Simultaneous administration refers to administration of two or more formulations at the same time or substantially at the same time (e.g., within seconds or just a few minutes apart), where the intent is that the formulations be administered together at the same time.

Modified Cells and Organisms

General Discussion

One or more components of the engineered CRISPR-Cas system described herein, polynucleotides and/or vectors encoding one or more components of the engineered CRISPR-Cas system described herein, and/or one or more viral particles carrying a polynucleotide encoding one or more components of the engineered CRISPR-Cas systems described herein can be delivered to one or more cells. In some embodiments, the cells can be ex vivo. In some embodiments, the cells are in vivo. As such, also described herein are cells that can include and/or express one or more components of the engineered CRISPR-Cas system described herein. Thus, also contemplated herein are organisms that can express in one or more cells one or more component of the engineered CRISPR-Cas system described herein. In some instances, the organism is a mosaic. In some instances, the organism can express one or more components of the engineered CRISPR-Cas system described herein in all cells. The polypeptides, polynucleotides, and vectors described herein can be used to modify one or more cells and/or be used to generate organisms to contain one or more modified cells.

As used herein, the term "Cas transgenic cell" refers to a cell, such as a eukaryotic cell, in which a Cas gene has been genomically integrated. The nature, type, or origin of the cell are not particularly limiting according to the present invention. Also, the way the Cas transgene is introduced in the cell may vary and can be any method as is known in the art. In certain embodiments, the Cas transgenic cell is obtained by introducing the Cas transgene in an isolated cell. In certain other embodiments, the Cas transgenic cell is obtained by isolating cells from a Cas transgenic organism.

Applications, uses, and actions of the engineered CRISPR-Cas system described herein and components thereof, such as genome modification of a cell, screening methods, animal model generation, treatment of a diseases are described elsewhere herein.

Modified Cells

In some embodiments, the modified cell can be a prokaryotic cell. The prokaryotic cells can be bacterial cells. The bacterial cell can be any suitable strain of bacterial cell.

In some embodiments, the modified cell can be a eukaryotic cell. The eukaryotic cells may be those of or derived from a particular organism, such as a plant or a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded.

In certain embodiments, the methods as described herein may comprise providing a Cas transgenic cell in which one or more nucleic acids encoding one or more guide RNAs are provided or introduced operably connected in the cell with a regulatory element comprising a promoter of one or more gene of interest. By means of example, and without limitation, the Cas transgenic cell as referred to herein may be derived from a Cas transgenic eukaryote, such as a Cas knock-in eukaryote. Reference is made to WO 2014/093622 (PCT/US13/74667), incorporated herein by reference. Methods of US Patent Publication Nos. 20120017290 and 20110265198 assigned to Sangamo BioSciences, Inc. directed to targeting the Rosa locus may be modified to utilize the CRISPR Cas system of the present invention. Methods of US Patent Publication No. 20130236946 assigned to Cellectis directed to targeting the Rosa locus may also be modified to utilize the CRISPR Cas system of the present invention. By means of further example reference is made to Platt et. al. (Cell; 159(2):440-455 (2014)), describing a Cas9 knock-in mouse, which is incorporated herein by reference and can be adapted for use with the Type II-D CRISPR-Cas systems and components thereof described herein. The Cas transgene can further comprise a Lox-Stop-polyA-Lox(LSL) cassette thereby rendering Cas expression inducible by Cre recombinase. Alternatively, the Cas transgenic cell may be obtained by introducing the Cas transgene in an isolated cell. Delivery systems for transgenes are well known in the art. By means of example, the Cas transgene may be delivered in for instance eukaryotic cell by means of vector (e.g., AAV, adenovirus, lentivirus) and/or particle and/or nanoparticle delivery, as also described herein elsewhere.

It will be understood by the skilled person that the cell, such as the Cas transgenic cell, as referred to herein may comprise further genomic alterations besides having an integrated Cas gene or the mutations arising from the sequence specific action of Cas when complexed with RNA capable of guiding Cas to a target locus.

In some embodiments, the cell is a cell obtained from a subject to be treated with a CRISPR-based therapy described herein or a cell line made therefrom: In some embodiments, the cell is a cell not obtained or derived from the subject to be treated with a CRISPR-based therapy described herein. A wide variety of cell lines for tissue culture are known in the art. Examples of cell lines include, but are not limited to, C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, C1R, Rat6, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRC5, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-1 cells, BEAS-2B, bEnd.3, BHK-21, BR 293, BxPC3, C3H-10T1/2, C6/36, Cal-27, CHO, CHO-7, CHO-IR, CHO-K1, CHO-K2, CHO-T, CHO Dhfr–/–, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepalc1c7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK II, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof. Cell lines are available from a variety of sources known to those with skill in the art (see, e.g., the American Type Culture Collection (ATCC) (Manassas, Va.)).

In some embodiments, a cell transfected with one or more vectors, polynucleotides, proteins, complexes, described herein or a combination thereof is/are used to establish a new cell line comprising one or more vector-derived sequences. In some embodiments, a cell transiently transfected with the components of a CRISPR system as described herein (such as by transient transfection of one or more vectors, or transfection with RNA, and/or CRISPR-Cas complex), and modified through the activity of a CRISPR complex, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

In some embodiments, the invention provides a eukaryotic host cell comprising (a) a first regulatory element operably linked to a tracr mate sequence and one or more insertion sites for inserting one or more guide sequences upstream of the tracr mate sequence, wherein when expressed, the guide sequence directs sequence-specific binding of a AAV-CRISPR complex to a target sequence in a eukaryotic cell, wherein the AAV-CRISPR complex comprises a AAV-CRISPR enzyme complexed with (1) the guide sequence that is hybridized to the target sequence, and (2) the tracr mate sequence that is hybridized to the tracr sequence; and/or (b) a said AAV-CRISPR enzyme optionally comprising at least one nuclear localization sequence and/or NES. In some embodiments, the host cell comprises components (a) and (b). In some embodiments, component (a), component (b), or components (a) and (b) are stably integrated into a genome of the host eukaryotic cell. In some embodiments, component (b) includes or contains component (a). In some embodiments, component (a) further comprises the tracr sequence downstream of the tracr mate sequence under the control of the first regulatory element. In some embodiments, component (a) further comprises two or more guide sequences operably linked to the first regulatory element, wherein when expressed, each of the two or more guide sequences direct sequence specific binding of an AAV-CRISPR complex to a different target sequence in a eukaryotic cell. In some embodiments, the eukaryotic host cell further comprises a third regulatory element, such as a polymerase III promoter, operably linked to said tracr sequence. In some embodiments, the tracr sequence exhibits at least 50%, 60%, 70%, 80%, 90%, 95%, or 99% of sequence complementarity along the length of the tracr mate sequence when optimally aligned.

In some embodiments, a eukaryotic host cell contains or otherwise includes (a) a first regulatory element operably linked to a direct repeat sequence and one or more insertion sites for inserting one or more guide RNA sequences up- or downstream (whichever applicable) of the direct repeat sequence, wherein when expressed, the guide sequence(s) direct(s) sequence-specific binding of the Cas CRISPR complex to the respective target sequence(s) in a eukaryotic cell, wherein the Cas CRISPR complex comprises a Cas enzyme complexed with the one or more guide sequence(s) that is hybridized to the respective target sequence(s); and/or (b) a second regulatory element operably linked to an enzyme-coding sequence encoding said Cas enzyme (e.g., a small Type II-D Cas protein or variant described in greater detail elsewhere herein) comprising at least one nuclear localization sequence and/or NES. In some embodiments, the host cell comprises components (a) and (b). Where applicable, a tracr sequence may also be provided. In some embodiments, component (a), component (b), or components (a) and (b) are stably integrated into a genome of the host eukaryotic cell. In some embodiments, component (a) further comprises two or more guide sequences operably linked to the first regulatory element, and optionally separated by a direct repeat, wherein when expressed, each of the two or more guide sequences direct sequence specific binding of a CRISPR-Cas complex to a different target sequence in a eukaryotic cell. In some embodiments, the Cas enzyme comprises one or more nuclear localization sequences and/or nuclear export sequences or NES of sufficient strength to drive accumulation of said Cas enzyme in a detectable amount in and/or out of the nucleus of a eukaryotic cell.

Modified Organisms

Also described herein are genetically modified organisms that are generated via a CRISPR-Cas system described in greater detail elsewhere herein. A wide variety of animals, plants, algae, fungi, yeast, etc. and animal, plant, algae, fungus, yeast cell or tissue systems can be engineered for the desired physiological and agronomic characteristics described herein using the nucleic acid constructs of the present disclosure (e.g., the CRISRP-Cas systems described herein) and the various transformation methods mentioned elsewhere herein. In certain embodiments, one or more cells of a plant, animal, algae, fungus, yeast contain one or more polynucleotides, vectors, proteins, complexes or a polynucleotide encoding one or more components of the engineered CRISPR-Cas system described herein. In some embodiments, the polynucleotide(s) encoding one or more components of the engineered CRISPR-Cas system described herein can be stably or transiently incorporated into one or more cells of a plant, animal, algae, fungus, and/or yeast or tissue system. In some embodiments, one or more of the engineered CRISPR-Cas system polynucleotides are genomically incorporated into one or more cells of a plant, animal, algae, fungus, and/or yeast or tissue system. Further embodiments and features of the modified organisms and systems are described elsewhere herein.

In some embodiments, one or more components of the engineered CRISPR-Cas system described herein is/are expressed in one or more cells of the plant, animal, algae, fungus, yeast, or tissue systems. In some embodiments, the engineered CRISPR-Cas system described herein can act on a target polynucleotide within the one or more cells of the plant, animal, algae, fungus, yeast, or tissue systems to result in sequence modification of the target polynucleotide. The target polynucleotide can be a genomic polynucleotide. The target polynucleotide can be a non-genomic polynucleotide. Additional methods of polynucleotide modification using the engineered CRISPR-Cas system described herein are provided elsewhere herein.

In some embodiments, a non-human eukaryotic organism; preferably a multicellular eukaryotic organism, containing a eukaryotic host cell containing one or more components of a engineered CRISPR-Cas system described herein according to any of the described embodiments. In some embodiments, a eukaryotic organism; preferably a multicellular eukaryotic organism, comprising a eukaryotic host cell containing one or more components of an engineered CRISPR-Cas system described herein according to any of the described embodiments. Advantageously the organism is a host of AAV.

The methods for genome editing also described elsewhere herein using the Cas system as described herein can be used to confer desired traits on essentially any animal plant, algae, fungus, yeast, etc. A wide variety of animals, plants, algae, fungus, yeast, etc. and plant algae, fungus, yeast cell or tissue systems may be engineered for the desired physiological and agronomic characteristics described herein using the nucleic acid constructs of the present disclosure and the various transformation and/or delivery methods described elsewhere herein. Various methods (e.g. delivery and transformation methods) described elsewhere herein can result in the generation of "improved animals, plants, algae, fungi, yeast, etc." in that they have one or more desirable traits compared to the wildtype animal, plant, algae, fungi, yeast, etc. In particular embodiments, the plants, algae, fungi, yeast, etc., cells or parts obtained are transgenic plants, comprising an exogenous DNA sequence incorporated into the genome of all or part of the cells. In particular embodiments, non-transgenic genetically modified animals, plants, algae, fungi, yeast, etc., parts or cells are obtained, in that no exogenous DNA sequence is incorporated into the genome of any of the cells of the modified animals, plants, algae, fungi, yeast, etc. In such embodiments, the improved animals, plants, algae, fungi, yeast, etc. are non-transgenic. Accordingly, as used herein, a "non-transgenic" animal, plant, algae, fungi, yeast, etc. or cell thereof is an animal, plant, algae, fungi, yeast, etc. or cell thereof which does not contain a foreign DNA stably integrated into its genome.

Thus, the invention provides a plant, animal or cell, produced by any one or more of the methods described herein, or a progeny thereof. The progeny may be a clone of the produced plant or animal or may result from sexual reproduction by crossing with other individuals of the same species to introgress further desirable traits into their offspring. The cell may be in vivo or ex vivo in the cases of multicellular organisms, particularly animals or plants.

Where only the modification of an endogenous gene is ensured and no foreign genes are introduced or maintained in the animal, plant, algae, fungi, yeast, etc. genome, the resulting genetically modified crops contain no foreign genes and can thus basically be considered non-transgenic but yet are not identical to the natural state or wild-type. The different applications of the CRISPR-Cas system for animal, plant, algae, fungi, yeast, etc. genome editing include, but are not limited to: introduction of one or more foreign genes to confer a performance, and/or agricultural trait of interest; editing of endogenous genes to confer a performance and/or agricultural trait of interest; modulating of endogenous genes by the CRISPR-Cas system to confer a performance and/or agricultural trait of interest.

In particular embodiments, the methods described herein are used to modify endogenous genes or to modify their expression without the permanent introduction into the genome of the animal, plant, algae, fungus, yeast, etc. of any foreign gene, including those encoding CRISPR components, so as to avoid the presence of foreign DNA in the genome of the plant.

Modified Animals

The organism in some embodiments may be an animal, for example, a mammal. In certain embodiments, the organism is a non-human mammal. In some embodiments, a non-human eukaryotic organism; preferably a multicellular eukaryotic organism, including a eukaryotic host cell according to any of the described embodiments. In some embodiments, a eukaryotic organism; preferably a multicellular eukaryotic organism, includes a eukaryotic host cell according to any of the described embodiments. Also, the organism may be an arthropod such as an insect. The present invention may also be extended to other agricultural applications such as, for example, farm and production animals. For example, pigs have many features that make them attractive as biomedical models, especially in regenerative medicine. In particular, pigs with severe combined immunodeficiency (SCID) may provide useful models for regenerative medicine, xenotransplantation (discussed also elsewhere herein), and tumor development and will aid in developing therapies for human SCID patients. Lee et al., (Proc Natl Acad Sci USA. 2014 May 20; 111(20):7260-5) utilized a reporter-guided transcription activator-like effector nuclease (TALEN) system to generated targeted modifications of recombination activating gene (RAG) 2 in somatic cells at high efficiency, including some that affected both alleles.

The methods of Lee et al., (Proc Natl Acad Sci USA. 2014 May 20; 111(20):7260-5) may be applied to the present invention analogously as follows. Mutated pigs are produced by targeted modification of RAG2 in fetal fibroblast cells followed by SCNT and embryo transfer. Constructs coding for CRISPR Cas and a reporter are electroporated into fetal-derived fibroblast cells. After 48 h, transfected cells expressing the green fluorescent protein are sorted into individual wells of a 96-well plate at an estimated dilution of a single cell per well. Targeted modification of RAG2 are screened by amplifying a genomic DNA fragment flanking any CRISPR Cas cutting sites followed by sequencing the PCR products. After screening and ensuring lack of off-site mutations, cells carrying targeted modification of RAG2 are used for SCNT. The polar body, along with a portion of the adjacent cytoplasm of oocyte, presumably containing the metaphase II plate, are removed, and a donor cell are placed in the perivitelline. The reconstructed embryos are then electrically porated to fuse the donor cell with the oocyte and then chemically activated. The activated embryos are incubated in Porcine Zygote Medium 3 (PZM3) with 0.5 µM Scriptaid (S7817; Sigma-Aldrich) for 14-16 h. Embryos are then washed to remove the Scriptaid and cultured in PZM3 until they were transferred into the oviducts of surrogate pigs.

The present invention is also applicable to modifying SNPs of other animals, such as cows. Tan et al. (Proc Natl Acad Sci USA. 2013 Oct. 8; 110(41): 16526-16531) expanded the livestock gene editing toolbox to include transcription activator-like (TAL) effector nuclease (TALEN)- and clustered regularly interspaced short palindromic repeats (CRISPR)/Cas (e.g., Type II-D Cas)-stimulated homology-directed repair (HDR) using plasmid, rAAV, and oligonucleotide templates. Gene specific gRNA sequences were cloned into the Church lab gRNA vector (Addgene ID: 41824) according to their methods (Mali P, et al. (2013) RNA-Guided Human Genome Engineering via Cas9. Science 339(6121):823-826). The Cas9 nuclease was provided either by co-transfection of the hCas9 plasmid (Addgene ID: 41815) or mRNA synthesized from RCIScript-hCas9. This RCIScript-hCas9 was constructed by subcloning the XbaI-AgeI fragment from the hCas9 plasmid (encompassing the hCas9 cDNA) into the RCIScript plasmid. Similar approaches can be applied in the case of the Type II-D Cas proteins and systems thereof of the present invention.

Heo et al. (Stem Cells Dev. 2015 Feb. 1; 24(3):393-402. doi: 10.1089/scd.2014.0278. Epub 2014 Nov. 3) reported highly efficient gene targeting in the bovine genome using bovine pluripotent cells and clustered regularly interspaced short palindromic repeat (CRISPR)/Cas9 nuclease. First, Heo et al. generate induced pluripotent stem cells (iPSCs) from bovine somatic fibroblasts by the ectopic expression of yamanaka factors and GSK3β and MEK inhibitor (2i) treatment. Heo et al. observed that these bovine iPSCs are highly similar to naïve pluripotent stem cells with regard to gene expression and developmental potential in teratomas. Moreover, CRISPR-Cas9 nuclease, which was specific for the bovine NANOG locus, showed highly efficient editing of the bovine genome in bovine iPSCs and embryos. A similar approach can be applied and/or adapted for use with the Cas (e.g., Type II-D Cas) proteins of the CRISPR-Cas systems described herein.

Igenity® provides a profile analysis of animals, such as cows, to perform and transmit traits of economic traits of economic importance, such as carcass composition, carcass quality, maternal and reproductive traits and average daily gain. The analysis of a comprehensive Igenity® profile begins with the discovery of DNA markers (most often single nucleotide polymorphisms or SNPs). All the markers behind the Igenity® profile were discovered by independent scientists at research institutions, including universities, research organizations, and government entities such as USDA. Markers are then analyzed at Igenity® in validation populations. Igenity® uses multiple resource populations that represent various production environments and biological types, often working with industry partners from the seedstock, cow-calf, feedlot and/or packing segments of the beef industry to collect phenotypes that are not commonly available. Cattle genome databases are widely available, see, e.g., the NAGRP Cattle Genome Coordination Program (http://www.animalgenome.org/cattle/maps/db.html). Thus, the present invention may be applied to target bovine SNPs. One of skill in the art may utilize the above protocols for targeting SNPs and apply them to bovine SNPs as described, for example, by Tan et al. or Heo et al.

Qingjian Zou et al. (Journal of Molecular Cell Biology Advance Access published Oct. 12, 2015) demonstrated increased muscle mass in dogs by targeting the first exon of the dog Myostatin (MSTN) gene (a negative regulator of skeletal muscle mass). First, the efficiency of the sgRNA was validated, using cotransfection of the sgRNA targeting MSTN with a Cas9 vector into canine embryonic fibroblasts (CEFs). Thereafter, MSTN KO dogs were generated by micro-injecting embryos with normal morphology with a mixture of Cas9 mRNA and MSTN sgRNA and auto-transplantation of the zygotes into the oviduct of the same female dog. The knock-out puppies displayed an obvious muscular phenotype on thighs compared with its wild-type littermate sister. Similar approaches can be applied and/or adapted for the CRISPR-Cas systems incorporating one or more Cas (e.g., Type II-D Cas) proteins described elsewhere herein.

Viral targets in livestock may include, in some embodiments, porcine CD163, for example on porcine macrophages. CD163 is associated with infection (thought to be through viral cell entry) by PRRSv (Porcine Reproductive and Respiratory Syndrome virus, an arterivirus). Infection by PRRSv, especially of porcine alveolar macrophages (found in the lung), results in a previously incurable porcine syndrome ("Mystery swine disease" or "blue ear disease") that causes suffering, including reproductive failure, weight loss and high mortality rates in domestic pigs. Opportunistic infections, such as enzootic pneumonia, meningitis and ear oedema, are often seen due to immune deficiency through loss of macrophage activity. It also has significant economic and environmental repercussions due to increased antibiotic use and financial loss (an estimated $660m per year).

As reported by Kristin M Whitworth and Dr Randall Prather et al. (Nature Biotech 3434 published online 7 Dec. 2015) at the University of Missouri and in collaboration with Genus Plc, CD163 was targeted using CRISPR-Cas9 and the offspring of edited pigs were resistant when exposed to PRRSv. One founder male and one founder female, both of whom had mutations in exon 7 of CD163, were bred to produce offspring. The founder male possessed an 11-bp deletion in exon 7 on one allele, which results in a frameshift mutation and missense translation at amino acid 45 in domain 5 and a subsequent premature stop codon at amino acid 64. The other allele had a 2-bp addition in exon 7 and a 377-bp deletion in the preceding intron, which were predicted to result in the expression of the first 49 amino acids of domain 5, followed by a premature stop code at amino acid 85. The sow had a 7 bp addition in one allele that when translated was predicted to express the first 48 amino acids of domain 5, followed by a premature stop codon at amino acid 70. The sow's other allele was unamplifiable. Selected offspring were predicted to be a null animal (CD163−/−), i.e., a CD163 knock out.

Accordingly, in some embodiments, porcine alveolar macrophages may be targeted by the CRISPR proteins (e.g., the Type II-D Cas proteins) described herein. In some embodiments, porcine CD163 may be targeted by the CRISPR protein. In some embodiments, porcine CD163 may be knocked out through induction of a DSB or through insertions or deletions, for example targeting deletion or modification of exon 7, including one or more of those described above, or in other regions of the gene, for example deletion or modification of exon 5.

An edited pig and its progeny are also envisaged, for example a CD163 knock out pig. This may be for livestock, breeding or modelling purposes (i.e. a porcine model). Semen comprising the gene knock out is also provided.

CD163 is a member of the scavenger receptor cysteine-rich (SRCR) superfamily. Based on in vitro studies SRCR domain 5 of the protein is the domain responsible for unpackaging and release of the viral genome. As such, other members of the SRCR superfamily may also be targeted in order to assess resistance to other viruses. PRRSV is also a member of the mammalian arterivirus group, which also includes murine lactate dehydrogenase-elevating virus, simian hemorrhagic fever virus and equine arteritis virus. The arteriviruses share important pathogenesis properties, including macrophage tropism and the capacity to cause both severe disease and persistent infection. Accordingly, arteriviruses, and in particular murine lactate dehydrogenase-elevating virus, simian hemorrhagic fever virus and equine arteritis virus, may be targeted, for example through porcine CD163 or homologues thereof in other species, and murine, simian and equine models and knockout also provided.

Indeed, this approach may be extended to viruses or bacteria that cause other livestock diseases that may be transmitted to humans, such as Swine Influenza Virus (SIV) strains which include influenza C and the subtypes of influenza A known as H1N1, H1N2, H2N1, H3N1, H3N2, and H2N3, as well as pneumonia, meningitis and oedema mentioned above.

Kabadi et al. (Nucleic Acids Res. 2014 Oct. 29; 42(19): e147. doi: 10.1093/nar/gku749. Epub 2014 Aug. 13) developed a single lentiviral system to express a Cas9 variant, a reporter gene and up to four sgRNAs from independent RNA polymerase III promoters that are incorporated into the vector by a convenient Golden Gate cloning method. Each sgRNA was efficiently expressed and can mediate multiplex gene editing and sustained transcriptional activation in immortalized and primary human cells. The methods of Kabadi et al. may be applied to the Cas (e.g., the Type II-D Cas) effector protein and systems thereof of the present invention.

Modified Plants and Algae

The present invention also provides plants cells obtainable and obtained by the methods provided herein. The improved plants obtained by the methods described herein may be useful in food or feed production through expression of genes which, for instance ensure tolerance to plant pests, herbicides, drought, low or high temperatures, excessive water, etc.

The improved plants obtained by the methods described herein, especially crops and algae may be useful in food or feed production through expression of, for instance, higher protein, carbohydrate, nutrient or vitamin levels than would normally be seen in the wildtype. In this regard, improved plants, especially pulses and tubers are preferred.

Improved algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

The invention also provides for improved parts of a plant. Plant parts include, but are not limited to, leaves, stems, roots, tubers, seeds, endosperm, ovule, and pollen. Plant parts as envisaged herein may be viable, nonviable, regeneratable, and/or non-regeneratable.

It is also encompassed herein to provide plant cells and plants generated according to the methods of the invention. Gametes, seeds, embryos, either zygotic or somatic, progeny or hybrids of plants comprising the genetic modification, which are produced by traditional breeding methods, are also included within the scope of the present invention. Such plants may contain a heterologous or foreign DNA sequence inserted at or instead of a target sequence. Alternatively, such plants may contain only an alteration (mutation, deletion, insertion, substitution) in one or more nucleotides. As such, such plants will only be different from their progenitor plants by the presence of the particular modification.

In some embodiments, the modified organism is a plant. In general, the term "plant" relates to any various photosynthetic, eukaryotic, unicellular or multicellular organism of the kingdom Plantae characteristically growing by cell division, containing chloroplasts, and having cell walls comprised of cellulose. The term plant encompasses monocotyledonous and dicotyledonous plants. Specifically, the plants are intended to comprise without limitation angiosperm and gymnosperm plants such as acacia, alfalfa, amaranth, apple, apricot, artichoke, ash tree, asparagus, avocado, banana, barley, beans, beet, birch, beech, blackberry, blueberry, broccoli, Brussel's sprouts, cabbage, canola, cantaloupe, carrot, cassava, cauliflower, cedar, a cereal, celery, chestnut, cherry, Chinese cabbage, citrus, clementine, clover, coffee, corn, cotton, cowpea, cucumber, cypress, eggplant, elm, endive, eucalyptus, fennel, figs, fir, geranium, grape, grapefruit, groundnuts, ground cherry, gum hemlock, hickory, kale, kiwifruit, kohlrabi, larch, lettuce, leek, lemon, lime, locust, pine, maidenhair, maize, mango, maple, melon, millet, mushroom, mustard, nuts, oak, oats, oil palm, okra, onion, orange, an ornamental plant or flower or tree, papaya, palm, parsley, parsnip, pea, peach, peanut, pear, peat, pepper, persimmon, pigeon pea, pine, pineapple, plantain, plum, pomegranate, potato, pumpkin, radicchio, radish, rapeseed, raspberry, rice, rye, sorghum, safflower, sallow, soybean, spinach, spruce, squash, strawberry, sugar beet, sugarcane, sunflower, sweet potato, sweet corn, tangerine, tea, tobacco, tomato, trees, triticale, turf grasses, turnips, vine, walnut, watercress, watermelon, wheat, yams, yew, and zucchini. The term plant also encompasses Algae, which are mainly photoautotrophs unified primarily by their lack of roots, leaves and other organs that characterize higher plants.

The methods for genome editing using the CRISPR-Cas system as described herein can be used to confer desired traits on essentially any plant. A wide variety of plants and plant cell systems may be engineered for the desired physiological and agronomic characteristics described herein using the nucleic acid constructs of the present disclosure and the various transformation methods mentioned above. In preferred embodiments, target plants and plant cells for engineering include, but are not limited to, those monocotyledonous and dicotyledonous plants, such as crops including grain crops (e.g., wheat, maize, rice, millet, barley), fruit crops (e.g., tomato, apple, pear, strawberry, orange), forage crops (e.g., alfalfa), root vegetable crops (e.g., carrot, potato, sugar beets, yam), leafy vegetable crops (e.g., lettuce, spinach); flowering plants (e.g., petunia, rose, chrysanthemum), conifers and pine trees (e.g., pine fir, spruce); plants used in phytoremediation (e.g., heavy metal accumulating plants); oil crops (e.g., sunflower, rape seed) and plants used for experimental purposes (e.g., *Arabidopsis*). Thus, the methods and CRISPR-Cas systems can be used over a broad range of plants, such as for example with dicotyledonous plants belonging to the orders Magnoliales, Illiciales, Laurales, Piperales, Aristolochiales, Nymphaeales, Ranunculales, Papaverales, Sarraceniaceae, Trochodendrales, Hamamelidales, Eucommiales, Leitneriales, Myricales, Fagales, Casuarinales, Caryophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, Halorogales, Myrtales, Cornales, Proteales, San tales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanulales, Rubiales, Dipsacales, and Asterales; the methods and CRISPR-Cas systems can be used with monocotyledonous plants such as those belonging to the orders Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Liliales, and Orchidales, or with plants belonging to Gymnospermae, e.g., those belonging to the orders Pinales, Ginkgoales, Cycadales, Araucariales, Cupressales and Gnetales.

The CRISPR-Cas systems and methods of use described herein can be used over a broad range of plant species, included in the non-limitative list of dicot, monocot or gymnosperm genera hereunder: *Atropa, Alseodaphne, Anacardium, Arachis, Beilschmiedia, Brassica, Carthamus, Cocculus, Croton, Cucumis, Citrus, Citrullus, Capsicum, Catharanthus, Cocos, Coffea, Cucurbita, Daucus, Duguetia, Eschscholzia, Ficus, Fragaria, Glaucium, Glycine, Gossypium, Helianthus, Hevea, Hyoscyamus, Lactuca, Landolphia, Linum, Litsea, Lycopersicon, Lupinus, Manihot, Majorana, Malus, Medicago, Nicotiana, Olea, Parthenium, Papaver, Persea, Phaseolus, Pistacia, Pisum, Pyrus, Prunus, Raphanus, Ricinus, Senecio, Sinomenium, Stephania, Sinapis, Solanum, Theobroma, Trifolium, Trigonella, Vicia, Vinca, Vilis,* and *Vigna*; and the genera *Allium, Andropogon, Eragrostis, Asparagus, Avena, Cynodon, Elaeis, Festuca, Festulolium, Heterocallis, Hordeum, Lemna, Lolium, Musa, Oryza, Panicum, Pennisetum, Phleum, Poa, Secale, Sorghum, Triticum, Zea, Abies, Cunninghamia, Ephedra, Picea, Pinus,* and *Pseudotsuga*.

The CRISPR-Cas systems and methods of use can also be used over a broad range of "algae" or "algae cells"; including for example algae selected from several eukaryotic phyla, including the Rhodophyta (red algae), Chlorophyta (green algae), Phaeophyta (brown algae), Bacillariophyta (diatoms), Eustigmatophyta and dinoflagellates as well as the prokaryotic phylum Cyanobacteria (blue-green algae). The term "algae" includes for example algae selected from: *Amphora, Anabaena, Ankistrodesmus, Botryococcus, Chaetoceros, Chlamydomonas, Chlorella, Chlorococcum, Cyclotella, Cylindrotheca, Dunaliella, Emiliania, Euglena, Haematococcus, Isochrysis, Monochrysis, Monoraphidium, Nannochloris, Nannochloropsis, Navicula, Nephrochloris, Nephroselmis, Nitzschia, Nodularia, Nostoc, Ochromonas, Oocystis, Oscillatoria, Pavlova, Phaeodactylum, Platymonas, Pleurochrysis, Porphyra, Pseudoanabaena, Pyramimonas, Stichococcus, Synechococcus, Synechocystis, Tetraselmis, Thalassiosira,* and *Trichodesmium*.

A part of a plant, i.e., a "plant tissue" may be treated according to the methods of the present invention to produce an improved plant. Plant tissue also encompasses plant cells. The term "plant cell" as used herein refers to individual units of a living plant, either in an intact whole plant or in an isolated form grown in in vitro tissue cultures, on media or agar, in suspension in a growth media or buffer or as a part of higher organized unites, such as, for example, plant tissue, a plant organ, or a whole plant.

A "protoplast" refers to a plant cell that has had its protective cell wall completely or partially removed using, for example, mechanical or enzymatic means resulting in an intact biochemical competent unit of living plant that can reform their cell wall, proliferate and regenerate grow into a whole plant under proper growing conditions.

The term "transformation" broadly refers to the process by which a plant host is genetically modified by the introduction of DNA by means of Agrobacteria or one of a variety of chemical or physical methods. As used herein, the term "plant host" refers to plants, including any cells, tissues, organs, or progeny of the plants. Many suitable plant tissues or plant cells can be transformed and include, but are not limited to, protoplasts, somatic embryos, pollen, leaves, seedlings, stems, calli, stolons, microtubers, and shoots. A plant tissue also refers to any clone of such a plant, seed, progeny, propagule whether generated sexually or asexually, and descendants of any of these, such as cuttings or seed.

The term "transformed" as used herein, refers to a cell, tissue, organ, or organism into which a foreign DNA molecule, such as a construct, has been introduced. The introduced DNA molecule may be integrated into the genomic DNA of the recipient cell, tissue, organ, or organism such that the introduced DNA molecule is transmitted to the subsequent progeny. In these embodiments, the "transformed" or "transgenic" cell or plant may also include progeny of the cell or plant and progeny produced from a breeding program employing such a transformed plant as a parent in a cross and exhibiting an altered phenotype resulting from the presence of the introduced DNA molecule. Preferably, the transgenic plant is fertile and capable of transmitting the introduced DNA to progeny through sexual reproduction.

The term "progeny", such as the progeny of a transgenic plant, is one that is born of, begotten by, or derived from a plant or the transgenic plant. The introduced DNA molecule may also be transiently introduced into the recipient cell such that the introduced DNA molecule is not inherited by subsequent progeny and thus not considered "transgenic".

The term "plant promoter" as used herein is a promoter capable of initiating transcription in plant cells, whether or not its origin is a plant cell. Exemplary suitable plant promoters include, but are not limited to, those that are obtained from plants, plant viruses, and bacteria such as *Agrobacterium* or *Rhizobium* which comprise genes expressed in plant cells.

One or more components of the CRISPR-Cas system described herein can be stably or transiently integrated into the genome of plants and plant cells.

In particular embodiments, it is envisaged that the polynucleotides encoding the components of the CRISPR-Cas system are introduced for stable integration into the genome of a plant cell. In these embodiments, the design of the transformation vector or the expression system can be adjusted depending on for when, where and under what conditions the guide RNA and/or the Cas (e.g., Type II-D Cas) protein gene(s) are expressed.

In particular embodiments, it is envisaged to introduce the components of the CRISPR-Cas system stably into the genomic DNA of a plant cell. Additionally or alternatively, the components of the CRISPR-Cas system are introduced for stable integration into the DNA of a plant organelle such as, but not limited to a plastid, e mitochondrion or a chloroplast.

The expression system for stable integration into the genome of a plant cell may contain one or more of the following elements: a promoter element that can be used to express the RNA and/or CRISPR-Cas enzyme in a plant cell; a 5' untranslated region to enhance expression; an intron element to further enhance expression in certain cells, such as monocot cells; a multiple-cloning site to provide convenient restriction sites for inserting the guide RNA and/or the CRISPR-Cas gene sequences and other desired elements; and a 3' untranslated region to provide for efficient termination of the expressed transcript.

The elements of the expression system may be on one or more expression constructs which are either circular such as a plasmid or transformation vector, or non-circular such as linear double stranded DNA.

In a particular embodiment, a Cfp1 CRISPR expression system comprises at least a nucleotide sequence encoding a guide RNA (gRNA) that hybridizes with a target sequence in a plant, and wherein the guide RNA comprises a guide sequence and a direct repeat sequence, and a nucleotide sequence encoding a CRISPR-Cas protein, wherein components (a) or (b) are located on the same or on different constructs, and whereby the different nucleotide sequences can be under control of the same or a different regulatory element operable in a plant cell.

DNA construct(s) containing the components of the CRISPR-Cas system, and, where applicable, template sequence may be introduced into the genome of a plant, plant part, or plant cell by a variety of conventional techniques. The process generally comprises the steps of selecting a suitable host cell or host tissue, introducing the construct(s) into the host cell or host tissue, and regenerating plant cells or plants therefrom:

In particular embodiments, the DNA construct may be introduced into the plant cell using techniques such as but not limited to electroporation, microinjection, aerosol beam injection of plant cell protoplasts, or the DNA constructs can be introduced directly to plant tissue using biolistic methods, such as DNA particle bombardment (see also Fu et al., Transgenic Res. 2000 February; 9(1):11-9). The basis of particle bombardment is the acceleration of particles coated with gene/s of interest toward cells, resulting in the penetration of the protoplasm by the particles and typically stable integration into the genome. (see e.g., Klein et al, Nature (1987), Klein et ah, Bio/Technology (1992), Casas et ah, Proc. Natl. Acad. Sci. USA (1993)).

In particular embodiments, the DNA constructs containing components of the CRISPR-Cas system may be introduced into the plant by *Agrobacterium*-mediated transformation. The DNA constructs may be combined with suitable T-DNA flanking regions and introduced into a conventional *Agrobacterium tumefaciens* host vector. The foreign DNA can be incorporated into the genome of plants by infecting the plants or by incubating plant protoplasts with *Agrobacterium* bacteria, containing one or more Ti (tumor-inducing) plasmids. (see e.g., Fraley et al., (1985), Rogers et al., (1987) and U.S. Pat. No. 5,563,055).

The CRISPR systems provided herein can be used to introduce targeted double-strand or single-strand breaks and/or to introduce into one or more plant cells or entire plants gene activator and/or repressor systems and without being limitative, can be used for gene targeting, gene replacement, targeted mutagenesis, targeted deletions or insertions, targeted inversions and/or targeted translocations. By co-expression of multiple targeting polynucleotides (e.g.) RNAs directed to achieve multiple modifications in a single cell, multiplexed genome modification can be ensured. This technology can be used to high-precision engineering of plants with improved characteristics, including enhanced nutritional quality, increased resistance to diseases and resistance to biotic and abiotic stress, and increased production of commercially valuable plant products or heterologous compounds.

In particular embodiments, the methods described herein are used to modify endogenous genes or to modify their expression without the permanent introduction into the genome of the plant, including those encoding CRISPR components, so as to avoid the presence of foreign DNA in the genome of the plant. This can be of interest as the regulatory requirements for non-transgenic plants are less rigorous.

Exemplary genes conferring agronomic traits include, but are not limited to, genes that confer resistance to pests or diseases; genes involved in plant diseases, such as those listed in WO 2013046247; genes that confer resistance to herbicides, fungicides, or the like; genes involved in (abiotic) stress tolerance. Other aspects of the use of the CRISPR-Cas system include, but are not limited to: create (male) sterile plants; increasing the fertility stage in plants/algae etc.; generate genetic variation in a crop of interest; affect fruit-ripening; increasing storage life of plants/algae etc.; reducing allergen in plants/algae etc.; ensure a value added trait (e.g. nutritional improvement); Screening methods for endogenous genes of interest; biofuel, fatty acid, organic acid, etc. production.

The CRISPR systems provided herein can be used to introduce targeted double-strand or single-strand breaks and/or to introduce gene activator and/or repressor systems and without being limitative, can be used for gene targeting, gene replacement, targeted mutagenesis, targeted deletions or insertions, targeted inversions and/or targeted translocations. By co-expression of multiple targeting RNAs directed to achieve multiple modifications in a single cell, multiplexed genome modification can be ensured. This technology can be used to high-precision engineering of plants with improved characteristics, including enhanced nutritional quality, increased resistance to diseases and resistance to biotic and abiotic stress, and increased production of commercially valuable plant products or heterologous compounds.

Chloroplast Targeting

In particular embodiments, the CRISPR-Cas system is used to specifically modify chloroplast genes or to ensure expression in the chloroplast. For this purpose, use is made of chloroplast transformation methods or compartmentalization of the CRISPR-Cas components to the chloroplast. For instance, the introduction of genetic modifications in the plastid genome can reduce biosafety issues such as gene flow through pollen.

Methods of chloroplast transformation are known in the art and include Particle bombardment, PEG treatment, and microinjection. Additionally, methods involving the translocation of transformation cassettes from the nuclear genome to the plastid can be used as described in WO2010061186.

Alternatively, it is envisaged to target one or more of the CRISPR-Cas components to the plant chloroplast. This is achieved by incorporating in the expression construct a sequence encoding a chloroplast transit peptide (CTP) or plastid transit peptide, operably linked to the 5' region of the sequence encoding the CRISPR-Cas protein. The CTP is removed in a processing step during translocation into the chloroplast. Chloroplast targeting of expressed proteins is well known to the skilled artisan (see for instance Protein Transport into Chloroplasts, 2010, Annual Review of Plant Biology, Vol. 61: 157-180). In such embodiments it is also desired to target the guide RNA to the plant chloroplast. Methods and constructs which can be used for translocating guide RNA into the chloroplast by means of a chloroplast localization sequence are described, for instance, in US 20040142476, incorporated herein by reference. Such variations of constructs can be incorporated into the expression systems of the invention to efficiently translocate the CRISPR-Cas-guide RNA.

Introduction of Polynucleotides in Algal Cells

Transgenic algae (or other plants such as rape) may be particularly useful in the production of vegetable oils or biofuels such as alcohols (especially methanol and ethanol) or other products. These may be engineered to express or overexpress high levels of oil or alcohols for use in the oil or biofuel industries.

U.S. Pat. No. 8,945,839 describes a method for engineering Micro-Algae (*Chlamydomonas reinhardtii* cells) species) using Cas9. Using similar tools, the methods of the CRISPR-Cas system described herein can be applied on *Chlamydomonas* species and other algae. In particular embodiments, Cas protein(s) (e.g., a small Type II-D Cas protein or variant thereof) and guide RNA are introduced in algae expressed using a vector that expresses Cas protein(s) (e.g., a small Type II-D Cas protein or variant thereof) under the control of a constitutive promoter such as Hsp70A-Rbc S2 or Beta2-tubulin. Guide RNA is optionally delivered using a vector containing T7 promoter. In some embodiments, a Cas protein(s) (e.g., a small Type II-D Cas protein or variant thereof) mRNA and in vitro transcribed guide RNA can be delivered to algal cells. Electroporation protocols are available to the skilled person such as the standard recommended protocol from the GeneArt *Chlamydomonas* Engineering kit.

In particular embodiments, the endonuclease used herein is a Split Cas (e.g., a split small Type II-D Cas protein or variant thereof) enzyme. Split Cas (e.g., a split small Type II-D Cas protein or variant thereof) enzymes are preferentially used in Algae for targeted genome modification similar to that which has been described for Cas9 in International Patent Publication No. WO 2015086795. Use of the Cas (e.g., a small Type II-D Cas protein or variant thereof) split system is particularly suitable for an inducible method of genome targeting and avoids the potential toxic effect of the Cas overexpression within the algae cell. In particular embodiments, a Cas (e.g., a small Type II-D Cas protein or variant thereof) proteins split domains (RuvC (inactive or active) and/or HNH domains and/or other catalytic domains) can be simultaneously or sequentially introduced into the cell such that said split Cas (e.g., a small Type II-D Cas protein or variant thereof) domain(s) process the target nucleic acid sequence in the algae or other cell. The reduced size of the split Cas (e.g., a small Type II-D Cas protein or variant thereof) protein compared to the wild type Cas (e.g., a small Type II-D Cas protein or variant thereof) protein allows other methods of delivery of the CRISPR system to the cells, such as the use of Cell Penetrating Peptides as described elsewhere herein. This method is of particular interest for generating genetically modified algae.

Modifying Algae and Plants for Production of Vegetable Oils or Biofuels

Transgenic algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries. The term "biofuel" as used herein is an alternative fuel made from plant and plant-derived resources. Renewable biofuels can be extracted from organic matter whose energy has been obtained through a process of carbon fixation or are made through the use or conversion of biomass. This biomass can be used directly for biofuels or can be converted to convenient energy containing substances by thermal conversion, chemical conversion, and biochemical conversion. This biomass conversion can result in fuel in solid, liquid, or gas form. There are two types of biofuels: bioethanol and biodiesel. Bioethanol is mainly produced by the sugar fermentation process of cellulose (starch), which is mostly derived from maize and sugar cane. Biodiesel on the other hand is mainly produced from oil crops such as rapeseed, palm, and soybean. Biofuels are used mainly for transportation. In some embodiments, the CRISPR-Cas system is used to generate lipid-rich diatoms which are useful in biofuel production.

In some embodiments, genes that are involved in the modification of the quantity of lipids and/or the quality of the lipids produced by the algal cell are specifically modified. Examples of genes encoding enzymes involved in the pathways of fatty acid synthesis can encode proteins having for instance acetyl-CoA carboxylase, fatty acid synthase, 3-ketoacyl_acyl-carrier protein synthase III, glycerol-3-phosphate dehydrogenase (G3PDH), Enoyl-acyl carrier protein reductase (Enoyl-ACP-reductase), glycerol-3-phosphate acyltransferase, lysophosphatidic acyl transferase or diacylglycerol acyltransferase, phospholipid:diacylglycerol acyltransferase, phosphatidate phosphatase, fatty acid thioesterase such as palmitoyl protein thioesterase, or malic enzyme activities. In further embodiments it is envisaged to generate diatoms that have increased lipid accumulation. This can be achieved by targeting genes that decrease lipid categorization. Of particular interest for use in the methods of the present invention are genes involved in the activation of both triacylglycerol and free fatty acids, as well as genes directly involved in β-oxidation of fatty acids, such as acyl-CoA synthetase, 3-ketoacyl-CoA thiolase, acyl-CoA oxidase activity and phosphoglucomutase. The CRISPR-Cas system and methods described herein can be used to specifically activate such genes in diatoms as to increase their lipid content.

Organisms such as microalgae are widely used for synthetic biology. Stovicek et al. (Metab. Eng. Comm., 2015; 2:13 describes genome editing of industrial yeast, for example, Saccharomyces cerevisiae, to efficiently produce robust strains for industrial production. Stovicek used a CRISPR-Cas9 system codon-optimized for yeast to simultaneously disrupt both alleles of an endogenous gene and knock in a heterologous gene. Cas9 and gRNA were expressed from genomic or episomal 2-based vector locations. The authors also showed that gene disruption efficiency could be improved by optimization of the levels of Cas9 and gRNA expression. Hlavovi et al. (Biotechnol. Adv. 2015) discusses development of species or strains of microalgae using techniques such as CRISPR to target nuclear and chloroplast genes for insertional mutagenesis and screening. The methods of Stovicek and Hlavovi may be applied and/or adapted to the Cas (e.g., a small Type II-D Cas protein or variant thereof) effector protein system of the present invention.

U.S. Pat. No. 8,945,839 describes a method for engineering Micro-Algae (*Chlamydomonas reinhardtii* cells) species) using Cas9. Using similar tools, the methods of the CRISPR-Cas system described herein can be applied on *Chlamydomonas* species and other algae. In particular embodiments, Cas (e.g., a small Type II-D Cas protein or variant thereof) protein(s) and guide RNA are introduced in algae expressed using a vector that expresses the Cas (e.g., a small Type II-D Cas protein or variant thereof) protein(s) under the control of a constitutive promoter such as Hsp70A-Rbc S2 or Beta2-tubulin. Guide RNA will be delivered using a vector containing T7 promoter. Alternatively, Cas (e.g., a small Type II-D Cas protein or variant thereof) mRNA(s) and in vitro transcribed guide RNA can be delivered to algal cells. Electroporation protocol follows standard recommended protocol from the GeneArt *Chlamydomonas* Engineering kit.

In particular embodiments, the methods using the CRISPR-Cas system as described herein are used to alter the properties of the cell wall in order to facilitate access by key hydrolyzing agents for a more efficient release of sugars for fermentation. In particular embodiments, the biosynthesis of cellulose and/or lignin are modified. Cellulose is the major component of the cell wall. The biosynthesis of cellulose and lignin are co-regulated. By reducing the proportion of lignin in a plant the proportion of cellulose can be increased. In particular embodiments, the methods described herein are used to downregulate lignin biosynthesis in the plant so as to increase fermentable carbohydrates. More particularly, the methods described herein are used to downregulate at least a first lignin biosynthesis gene selected from the group consisting of 4-coumarate 3-hydroxylase (C3H), phenylalanine ammonia-lyase (PAL), cinnamate 4-hydroxylase (C4H), hydroxycinnamoyl transferase (HCT), caffeic acid O-methyltransferase (COMT), caffeoyl CoA 3-O-methyltransferase (CCoAOMT), ferulate 5-hydroxylase (F5H), cinnamyl alcohol dehydrogenase (CAD), cinnamoyl CoA-reductase (CCR), 4-coumarate-CoA ligase (4CL), monolignol-lignin-specific glycosyltransferase, and aldehyde dehydrogenase (ALDH) as disclosed in WO 2008064289 A2.

In particular embodiments, the methods described herein are used to produce plant mass that produces lower levels of acetic acid during fermentation (see also WO 2010096488). More particularly, the methods disclosed herein are used to generate mutations in homologs to CaslL to reduce polysaccharide acetylation.

Transient Expression of CRISPR-Cas Systems and Components in Plant Cells

In particular embodiments, it is envisaged that the guide RNA and/or Cas (e.g., a small Type II-D Cas protein or variant thereof) gene are transiently expressed in the plant cell. In these embodiments, the CRISPR-Cas system can ensure modification of a target gene only when both the guide RNA and the Cas (e.g., a small Type II-D Cas protein or variant thereof) protein(s) is/are present in a cell, such that genomic modification can further be controlled. As the expression of the Cas (e.g., a small Type II-D Cas protein or variant thereof) protein(s) is transient, plants regenerated from such plant cells typic Cas (e.g., a small Type II-D Cas protein or variant thereof) protein(s) is stably expressed by the plant cell and the guide sequence is transiently expressed.

In particular embodiments, the CRISPR-Cas system components can be introduced in the plant cells using a plant viral vector (Scholthof et al. 1996, Annu Rev Phytopathol. 1996; 34:299-323). In further particular embodiments, said viral vector is a vector from a DNA virus. For example, geminivirus (e.g., cabbage leaf curl virus, bean yellow dwarf virus, wheat dwarf virus, tomato leaf curl virus, maize streak virus, tobacco leaf curl virus, or tomato golden mosaic virus) or nanovirus (e.g., *Faba* bean necrotic yellow virus). In other particular embodiments, said viral vector is a vector from an RNA virus. For example, tobravirus (e.g., tobacco rattle virus, tobacco mosaic virus), potexvirus (e.g., potato virus X), or hordeivirus (e.g., barley stripe mosaic virus). The replicating genomes of plant viruses are non-integrative vectors.

In particular embodiments, the vector used for transient expression of CRISPR-Cas constructs is for instance a pEAQ vector, which is tailored for *Agrobacterium*-mediated transient expression (Sainsbury F. et al., Plant Biotechnol. J. 2009 September; 7(7):682-93) in the protoplast. Precise targeting of genomic locations was demonstrated using a modified Cabbage Leaf Curl virus (CaLCuV) vector to express gRNAs in stable transgenic plants expressing a CRISPR enzyme (Scientific Reports 5, Article number: 14926 (2015), doi:10.1038/srep14926).

In particular embodiments, double-stranded DNA fragments encoding the guide RNA and/or the Cas (e.g., a small Type II-D Cas protein or variant thereof) gene(s) can be transiently introduced into the plant cell. In such embodiments, the introduced double-stranded DNA fragments are provided in sufficient quantity to modify the cell but do not persist after a contemplated period of time has passed or after one or more cell divisions. Methods for direct DNA transfer in plants are known by the skilled artisan (see for instance Davey et al. Plant Mol Biol. 1989 September; 13(3):273-85.)

In other embodiments, an RNA polynucleotide encoding the Cas (e.g., a small Type II-D Cas protein or variant thereof) protein(s) is/are introduced into the plant cell, which is then translated and processed by the host cell generating the protein in sufficient quantity to modify the cell (in the presence of at least one guide RNA) but which does not persist after a contemplated period of time has passed or after one or more cell divisions. Methods for introducing mRNA to plant protoplasts for transient expression are known by the skilled artisan (see for instance in Gallie, Plant Cell Reports (1993), 13; 119-122).

Combinations of the different methods described above are also envisaged.

Detecting Modifications in the Plant Genome Selectable Markers

In particular embodiments, where the method involves modification of an endogenous target gene of the plant genome, any suitable method can be used to determine, after the plant, plant part or plant cell is infected or transfected with the CRISPR-Cas system, whether gene targeting or targeted mutagenesis has occurred at the target site. Where the method involves introduction of a transgene, a transformed plant cell, callus, tissue or plant may be identified and isolated by selecting or screening the engineered plant material for the presence of the transgene or for traits encoded by the transgene. Physical and biochemical methods may be used to identify plant or plant cell transformants containing inserted gene constructs or an endogenous DNA modification. These methods include but are not limited to: 1) Southern analysis or PCR amplification for detecting and determining the structure of the recombinant DNA insert or modified endogenous genes; 2) Northern blot, S1 RNase protection, primer-extension or reverse transcriptase-PCR amplification for detecting and examining RNA transcripts of the gene constructs; 3) enzymatic assays for detecting enzyme or ribozyme activity, where such gene products are encoded by the gene construct or expression is affected by the genetic modification; 4) protein gel electrophoresis, Western blot techniques, immunoprecipitation, or enzyme-linked immunoassays, where the gene construct or endogenous gene products are proteins. Additional techniques, such as in situ hybridization, enzyme staining, and immunostaining, also may be used to detect the presence or expression of the recombinant construct or detect a modification of endogenous gene in specific plant organs and tissues. The methods for doing all these assays are well known to those skilled in the art.

Additionally (or alternatively), the expression system encoding the CRISPR-Cas components is typically designed to comprise one or more selectable or detectable markers that provide a means to isolate or efficiently select cells that contain and/or have been modified by the CRISPR-Cas system at an early stage and on a large scale.

In the case of *Agrobacterium*-mediated transformation, the marker cassette may be adjacent to or between flanking T-DNA borders and contained within a binary vector. In another embodiment, the marker cassette may be outside of the T-DNA. A selectable marker cassette may also be within or adjacent to the same T-DNA borders as the expression cassette or may be somewhere else within a second T-DNA on the binary vector (e.g., a 2 T-DNA system).

For particle bombardment or with protoplast transformation, the expression system can comprise one or more isolated linear fragments or may be part of a larger construct that might contain bacterial replication elements, bacterial selectable markers or other detectable elements. The expression cassette(s) comprising the polynucleotides encoding the guide and/or Cas (e.g., a small Type II-D Cas protein or variant thereof) proteins may be physically linked to a marker cassette or may be mixed with a second nucleic acid molecule encoding a marker cassette. The marker cassette is comprised of necessary elements to express a detectable or selectable marker that allows for efficient selection of transformed cells.

The selection procedure for the cells based on the selectable marker will depend on the nature of the marker gene. In particular embodiments, use is made of a selectable marker, i.e. a marker which allows a direct selection of the cells based on the expression of the marker. A selectable marker can confer positive or negative selection and is conditional or non-conditional on the presence of external substrates (Miki et al. 2004, 107(3): 193-232). Most commonly, antibiotic or herbicide resistance genes are used as a marker, whereby selection is be performed by growing the engineered plant material on media containing an inhibitory amount of the antibiotic or herbicide to which the marker gene confers resistance. Examples of such genes are genes that confer resistance to antibiotics, such as hygromycin (hpt) and kanamycin (nptII), and genes that confer resistance to herbicides, such as phosphinothricin (bar) and chlorsulfuron (als).

Transformed plants and plant cells may also be identified by screening for the activities of a visible marker, typically an enzyme capable of processing a colored substrate (e.g., the β-glucuronidase, luciferase, B or C1 genes). Such selection and screening methodologies are well known to those skilled in the art.

Plant Cultures and Regeneration

In particular embodiments, plant cells which have a modified genome and that are produced or obtained by any of the methods described herein, can be cultured to regenerate a whole plant which possesses the transformed or modified genotype and thus the desired phenotype. Conventional regeneration techniques are well known to those skilled in the art. Particular examples of such regeneration techniques rely on manipulation of certain phytohormones in a tissue culture growth medium, and typically relying on a biocide and/or herbicide marker which has been introduced together with the desired nucleotide sequences. In further particular embodiments, plant regeneration is obtained from cultured protoplasts, plant callus, explants, organs, pollens, embryos or parts thereof (see e.g., Evans et al. (1983), Handbook of Plant Cell Culture, Klee et al (1987) Ann. Rev. of Plant Phys.).

In particular embodiments, transformed or improved plants as described herein can be self-pollinated to provide seed for homozygous improved plants of the invention (homozygous for the DNA modification) or crossed with non-transgenic plants or different improved plants to provide seed for heterozygous plants. Where a recombinant DNA was introduced into the plant cell, the resulting plant of such a crossing is a plant which is heterozygous for the recombinant DNA molecule. Both such homozygous and heterozygous plants obtained by crossing from the improved plants and comprising the genetic modification (which can be a recombinant DNA) are referred to herein as "progeny". Progeny plants are plants descended from the original transgenic plant and containing the genome modification or recombinant DNA molecule introduced by the methods provided herein. Alternatively, genetically modified plants can be obtained by one of the methods described supra using the Cfp1 enzyme whereby no foreign DNA is incorporated into the genome. Progeny of such plants obtained by further breeding may also contain the genetic modification. Breedings are performed by any breeding methods that are commonly used for different crops (e.g., Allard, Principles of Plant Breeding, John Wiley & Sons, NY, U. of CA, Davis, CA, 50-98 (1960).

Generation of Plants with Enhanced Agronomic Traits

The CRISPR systems provided herein can be used to introduce targeted double-strand or single-strand breaks and/or to introduce gene activator and/or repressor systems and without being limitative, can be used for gene targeting, gene replacement, targeted mutagenesis, targeted deletions or insertions, targeted inversions and/or targeted translocations. By co-expression of multiple targeting RNAs directed to achieve multiple modifications in a single cell, multiplexed genome modification can be ensured. This technology can be used to high-precision engineering of plants with improved characteristics, including enhanced nutritional quality, increased resistance to diseases and resistance to biotic and abiotic stress, and increased production of commercially valuable plant products or heterologous compounds.

In particular embodiments, the CRISPR-Cas system as described herein is used to introduce targeted double-strand breaks (DSB) in an endogenous DNA sequence. The DSB activates cellular DNA repair pathways, which can be harnessed to achieve desired DNA sequence modifications near the break site. This is of interest where the inactivation of endogenous genes can confer or contribute to a desired trait. In particular embodiments, homologous recombination with a template sequence is promoted at the site of the DSB, in order to introduce a gene of interest.

In particular embodiments, the CRISPR-Cas system may be used as a generic nucleic acid binding protein with fusion to or being operably linked to a functional domain for activation and/or repression of endogenous plant genes. Exemplary functional domains may include but are not limited to translational initiator, translational activator, translational repressor, nucleases, in particular ribonucleases, a spliceosome, beads, a light inducible/controllable domain or a chemically inducible/controllable domain. Typically, in these embodiments, the Cas (e.g., a small Type II-D Cas protein or variant thereof) protein(s) comprises at least one mutation, such that it has no more than 5% of the activity of the Cas (e.g., a small Type II-D Cas protein or variant thereof) protein(s) not having the at least one mutation; the guide RNA comprises a guide sequence capable of hybridizing to a target sequence.

The methods described herein generally result in the generation of "improved plants" in that they have one or more desirable traits compared to the wildtype plant. In particular embodiments, the plants, plant cells or plant parts obtained are transgenic plants, comprising an exogenous DNA sequence incorporated into the genome of all or part of the cells of the plant. In particular embodiments, non-transgenic genetically modified plants, plant parts or cells are obtained, in that no exogenous DNA sequence is incorporated into the genome of any of the plant cells of the plant. In such embodiments, the improved plants are non-transgenic. Where only the modification of an endogenous gene is ensured and no foreign genes are introduced or maintained in the plant genome, the resulting genetically modified crops contain no foreign genes and can thus basically be considered non-transgenic. The different applications of the CRISPR-Cas system for plant genome editing are described more in detail below.

In further particular embodiments, crop plants can be improved by influencing specific plant traits. For example, by developing pesticide-resistant plants, improving disease resistance in plants, improving plant insect and nematode resistance, improving plant resistance against parasitic weeds, improving plant drought tolerance, improving plant nutritional value, improving plant stress tolerance, avoiding self-pollination, plant forage digestibility biomass, grain yield etc. A few specific non-limiting examples are provided hereinbelow.

In addition to targeted mutation of single genes, CRISPR complexes can be designed to allow targeted mutation of multiple genes, deletion of chromosomal fragment, site-specific integration of transgene, site-directed mutagenesis in vivo, and precise gene replacement or allele swapping in plants. Therefore, the methods described herein have broad applications in gene discovery and validation, mutational and cisgenic breeding, and hybrid breeding. These applications facilitate the production of a new generation of genetically modified crops with various improved agronomic traits such as herbicide resistance, disease resistance, abiotic stress tolerance, high yield, and superior quality.

Introduction of One or More Foreign Genes to Confer an Agricultural Trait of Interest The invention provides methods of genome editing or modifying sequences associated with or at a target locus of interest wherein the method comprises introducing a Cas (e.g., a small Type II-D Cas protein or variant thereof) effector protein complex(es) into a plant cell, whereby the Cas (e.g., a small Type II-D Cas protein or variant thereof) effector protein complex(es) effectively functions to integrate a DNA insert, e.g., encoding a foreign gene of interest, into the genome of the plant cell. In some embodiments the integration of the DNA insert is facilitated by HR with an exogenously introduced DNA template or repair template. Typically, the exogenously introduced DNA template or repair template is delivered together with the Cas (e.g., a small Type II-D Cas protein or variant thereof) effector protein complex(es) or one component or a polynucleotide vector for expression of a component of the complex(es).

The CRISPR-Cas systems provided herein allow for targeted gene delivery. It has become increasingly clear that the efficiency of expressing a gene of interest is to a great extent determined by the location of integration into the genome. The present methods allow for targeted integration of the foreign gene into a desired location in the genome. The location can be selected based on information of previously generated events or can be selected by methods disclosed elsewhere herein.

In particular embodiments, the methods provided herein include (a) introducing into the cell a CRISPR-Cas complex comprising a guide RNA, comprising a direct repeat and a guide sequence, wherein the guide sequence hybridizes to a target sequence that is endogenous to the plant cell; (b) introducing into the plant cell a Cas (e.g., a small Type II-D Cas protein or variant thereof) effector molecule(s), which complexes with the guide RNA when the guide sequence hybridizes to the target sequence and induces a double strand break at or near the sequence to which the guide sequence is targeted; and (c) introducing into the cell a nucleotide sequence encoding an HDR repair template and/or donor/insert polynucleotide which encodes the gene of interest and which is introduced into the location of the DS break as a result of HDR or other repair or other mechanism as described in greater detail elsewhere herein. In particular embodiments, the step of introducing can include delivering to the plant cell one or more polynucleotides encoding Cas (e.g., a small Type II-D Cas protein or variant thereof) effector protein(s), the guide RNA and the repair template and/or donor/insert polynucleotide. In particular embodiments, the polynucleotides are delivered into the cell by a DNA virus (e.g., a geminivirus) or an RNA virus (e.g., a tobravirus). In particular embodiments, the introducing steps include delivering to the plant cell a T-DNA containing one or more polynucleotide sequences encoding the Cas (e.g., a small Type II-D Cas protein or variant thereof) effector protein(s) the guide RNA and the repair template, where the delivering is via *Agrobacterium*. The nucleic acid sequence encoding the Cas (e.g. a small Type II-D Cas protein or variant thereof) effector protein(s) can be operably linked to a promoter, such as a constitutive promoter (e.g., a cauliflower mosaic virus 35S promoter), or a cell specific or inducible promoter. In particular embodiments, the polynucleotide is introduced by microprojectile bombardment. In particular embodiments, the method further includes screening the plant cell after the introducing steps to determine whether the repair template i.e., the gene of interest has been introduced. In particular embodiments, the methods include the step of regenerating a plant from the plant cell. In further embodiments, the methods include cross breeding the plant to obtain a genetically desired plant lineage. Examples of foreign genes encoding a trait of interest are listed below.

Editing of Endogenous Genes to Confer an Agricultural Trait of Interest

The invention provides methods of genome editing or modifying sequences associated with or at a target locus of interest wherein the method comprises introducing one or more Cas (e.g., a small Type II-D Cas protein or variant thereof) effector protein complex(es) into a plant cell, whereby the Cas (e.g., a small Type II-D Cas protein or variant thereof) complex(es) modifies the expression of an endogenous gene of the plant. This can be achieved in different ways. In particular embodiments, the elimination of expression of an endogenous gene is desirable and the CRISPR-Cas complex is used to target and cleave an endogenous gene so as to modify gene expression. In these embodiments, the methods provided herein include (a) introducing into the plant cell a CRISPR-Cas complex comprising a guide RNA, comprising a direct repeat and a guide sequence, wherein the guide sequence hybridizes to a target sequence within a gene of interest in the genome of the plant cell; and (b) introducing into the cell a Cas (e.g., a small Type II-D Cas protein or variant thereof) effector protein(s), which upon binding to the guide RNA comprises a guide sequence that is hybridized to the target sequence, ensures a double strand break at or near the sequence to which the guide sequence is targeted; In particular embodiments, the step of introducing can include delivering to the plant cell one or more polynucleotides encoding Cas (e.g., a small Type II-D Cas protein or variant thereof) effector protein(s) and the guide RNA.

In particular embodiments, the polynucleotides are delivered into the cell by a DNA virus (e.g., a geminivirus) or an RNA virus (e.g., a tobravirus). In particular embodiments, the introducing steps include delivering to the plant cell a T-DNA containing one or more polynucleotide sequences encoding the Cas (e.g., a small Type II-D Cas protein or variant thereof) effector protein(s) and the guide RNA, where the delivering is via *Agrobacterium*. The polynucleotide sequence encoding the components of the CRISPR-Cas system can be operably linked to a promoter, such as a constitutive promoter (e.g., a cauliflower mosaic virus 35S promoter), or a cell specific or inducible promoter. In particular embodiments, the polynucleotide is introduced by microprojectile bombardment. In particular embodiments, the method further includes screening the plant cell after the introducing steps to determine whether the expression of the gene of interest has been modified. In particular embodiments, the methods include the step of regenerating a plant from the plant cell. In further embodiments, the methods include cross breeding the plant to obtain a genetically desired plant lineage.

In particular embodiments of the methods described above, disease resistant crops are obtained by targeted mutation of disease susceptibility genes or genes encoding negative regulators (e.g. Mlo gene) of plant defense genes. In a particular embodiment, herbicide-tolerant crops are generated by targeted substitution of specific nucleotides in plant genes such as those encoding acetolactate synthase (ALS) and protoporphyrinogen oxidase (PPO). In particular embodiments drought and salt tolerant crops by targeted mutation of genes encoding negative regulators of abiotic stress tolerance, low amylose grains by targeted mutation of Waxy gene, rice or other grains with reduced rancidity by targeted mutation of major lipase genes in aleurone layer, etc. In particular embodiments. A more extensive list of endogenous genes encoding a traits of interest are listed below.

Modulating of Endogenous Genes by the CRISPR-Cas System to Confer an Agricultural Trait of Interest Also provided herein are methods for modulating (i.e., activating or repressing) endogenous gene expression using the Cas (e.g., a small Type II-D Cas protein or variant thereof) protein(s) provided herein. Such methods make use of distinct RNA sequence(s) which are targeted to the plant genome by the Cas (e.g., a small Type II-D Cas protein or variant thereof) complex(es). More particularly the distinct RNA sequence(s) bind to two or more adaptor proteins (e.g. aptamers) whereby each adaptor protein is associated with one or more functional domains and wherein at least one of the one or more functional domains associated with the adaptor protein have one or more activities comprising methylase activity, demethylase activity, transcription activation activity, transcription repression activity, transcription release factor activity, histone modification activity, DNA integration activity RNA cleavage activity, DNA cleavage activity or nucleic acid binding activity; The functional domains are used to modulate expression of an endogenous plant gene so as to obtain the desired trait. Typically, in these embodiments, the Cas (e.g., a small Type II-D Cas protein or variant thereof) effector protein(s) has one or more mutations such that it has no more than 5% of the nuclease activity of the Cas (e.g., a small Type II-D Cas protein or variant thereof) effector protein(s) not having the at least one mutation.

In particular embodiments, the methods provided herein include the steps of (a) introducing into the cell a CRISPR-Cas complex comprising a guide RNA, comprising a direct repeat and a guide sequence, wherein the guide sequence hybridizes to a target sequence that is endogenous to the plant cell; (b) introducing into the plant cell a Cas (e.g. a small Type II-D Cas protein or variant thereof) effector molecule(s) which complexes with the guide RNA when the guide sequence hybridizes to the target sequence; and wherein either the guide RNA is modified to comprise a distinct RNA sequence (aptamer) binding to a functional domain and/or the Cas (e.g. a small Type II-D Cas protein or variant thereof) effector protein(s) is modified in that it is linked to a functional domain. In particular embodiments, the step of introducing can include delivering to the plant cell one or more polynucleotides encoding the (modified) Cas (e.g., a small Type II-D Cas protein or variant thereof) effector protein(s) and the (modified) guide RNA. The details the components of the CRISPR-Cas system for use in these methods are described elsewhere herein.

In particular embodiments, the polynucleotides are delivered into the cell by a DNA virus (e.g., a geminivirus) or an RNA virus (e.g., a tobravirus). In particular embodiments, the introducing steps include delivering to the plant cell a T-DNA containing one or more polynucleotide sequences encoding the Cas (e.g., a small Type II-D Cas protein or variant thereof) effector protein (s) and the guide RNA, where the delivering is via *Agrobacterium*. The nucleic acid sequence encoding the one or more components of the CRISPR-Cas system can be operably linked to a promoter, such as a constitutive promoter (e.g., a cauliflower mosaic virus 35S promoter), or a cell specific or inducible promoter. In particular embodiments, the polynucleotide is introduced by microprojectile bombardment. In particular embodiments, the method further includes screening the plant cell after the introducing steps to determine whether the expression of the gene of interest has been modified. In particular embodiments, the methods include the step of regenerating a plant from the plant cell. In further embodiments, the methods include cross breeding the plant to obtain a genetically desired plant lineage. A more extensive list of endogenous genes encoding a traits of interest are listed below.

The CRISPR-Cas systems described here can be used to modify polyploid plants. Many plants are polyploid, which means they carry duplicate copies of their genomes-sometimes as many as six, as in wheat. The methods according to the present invention, which make use of the CRISPR-Cas effector protein can be "multiplexed" to affect all copies of a gene, or to target dozens of genes at once. For instance, in particular embodiments, the methods of the present invention are used to simultaneously ensure a loss of function mutation in different genes responsible for suppressing defenses against a disease. In particular embodiments, the methods of the present invention are used to simultaneously suppress the expression of the TaMLO-Al, TaMLO-Bl and TaMLO-Dl nucleic acid sequence in a wheat plant cell and regenerating a wheat plant therefrom, in order to ensure that the wheat plant is resistant to powdery mildew (see also WO2015109752).

Described herein are exemplary genes conferring agronomic traits. As described herein above, in particular embodiments, the invention encompasses the use of the CRISPR-Cas system as described herein for the insertion of a DNA of interest, including one or more plant expressible gene(s). In further particular embodiments, the invention encompasses methods and tools using the CRISPR-Cas system as described herein for partial or complete deletion of one or more plant expressed gene(s). In other further particular embodiments, the invention encompasses methods and tools using the CRISPR-Cas system as described herein to ensure modification of one or more plant-expressed genes by mutation, substitution, insertion of one of more nucleotides. In other particular embodiments, the invention encompasses the use of CRISPR-Cas system as described herein to ensure modification of expression of one or more plant-expressed genes by specific modification of one or more of the regulatory elements directing expression of said genes.

In particular embodiments, the invention encompasses methods which involve the introduction of exogenous genes and/or the targeting of endogenous genes and their regulatory elements, including but not limited to any of those further described below.

Genes that Confer Resistance to Pests or Diseases

In some embodiments, the modified plant or cell thereof can be modified to contain a gene or gene variant that can confer disease resistance to the plant or cell thereof. In some embodiments, an exogenous gene is introduced. In other embodiments, an endogenous gene can be modified to a disease-resistant variant of the endogenous gene. A plant can be transformed with cloned resistance genes to engineer plants that are resistant to specific pathogen strains. See, e.g., Jones et al., Science 266:789 (1994) (cloning of the tomato Cf-9 gene for resistance to *Cladosporium fulvum*); Martin et al., Science 262:1432 (1993) (tomato Pto gene for resistance to *Pseudomonas syringae* pv. tomato encodes a protein kinase); Mindrinos et al., Cell 78:1089 (1994) (Arabidopsmay be RSP2 gene for resistance to *Pseudomonas syringae*). A plant gene that is upregulated or down regulated during pathogen infection can be engineered for pathogen resistance. See, e.g., Thomazella et al., bioRxiv 064824; doi: https://doi.org/10.1101/064824 Epub. Jul. 23, 2016 (tomato plants with deletions in the SlDMR6-1 which is normally upregulated during pathogen infection). In some embodiments, the modified plant can be modified to express a gene that is resistant to specific pathogens by the CRISPR-Cas systems described herein.

In some embodiments, the modified plant can be modified to express one or more genes conferring resistance to a pest, such as soybean cyst nematode. See e.g., PCT Application WO 96/30517; PCT Application WO 93/19181.

In some embodiments, the modified plant can be modified with one or more genes whose gene products can repel, deter, and/or kill a plant pest (e.g. insect, animal, or other organism that is detrimental to the plant or another plant (e.g. in the case of a trap crop)). In some embodiments, such genes can be *Bacillus thuringiensis* proteins' genes, (see, e.g., Geiser et al., Gene 48:109 (1986)); lectins' gene(s) (see e.g. Van Damme et al., Plant Molec. Biol. 24:25 (1994); a vitamin-binding protein gene (e.g. avidin or avidin homologue) (see e.g., PCT application US93/06487), genes encoding enzyme inhibitors (e.g. protease or proteinase inhibitors and amylase inhibitors) (see e.g., Abe et al., J. Biol. Chem. 262:16793 (1987), Huub et al., Plant Molec. Biol. 21:985 (1993)), Sumitani et al., Biosci. Biotech. Biochem. 57:1243 (1993) and U.S. Pat. No. 5,494,813); insect-specific hormones or pheromones (e.g. ecdysteroid or juvenile hormone, a variant thereof, a mimetic based thereon, or an antagonist or agonist thereof) (see e.g. Hammock et al., Nature 344:458 (1990)); genes encoding insect-specific peptides which, upon expression, disrupts the physiology of the affected pest (see e.g. Regan, J. Biol. Chem. 269:9 (1994) and Pratt et al., Biochem. Biophys. Res. Comm. 163:1243 (1989). See also U.S. Pat. No. 5,266,317); genes encoding insect-specific venom or proteins thereof produced by a snake, a wasp, or any other organism (see e.g., Pang et al., Gene 116: 165 (1992)); genes encoding enzymes responsible for a hyperaccumulation of a monoterpene, a sesquiterpene, a steroid, hydroxamic acid, a phenylpropanoid derivative, or another nonprotein molecule with insecticidal activity; Enzymes involved in the modification, including the post-translational modification, of a biologically active molecule; for example, a glycolytic enzyme, a proteolytic enzyme, a lipolytic enzyme, a nuclease, a cyclase, a transaminase, an esterase, a hydrolase, a phosphatase, a kinase, a phosphorylase, a polymerase, an elastase, a chitinase and a glucanase, whether natural or synthetic (see e.g., PCT application WO93/02197, Kramer et al., Insect Biochem. Molec. Biol. 23:691 (1993) and Kawalleck et al., Plant Molec. Biol. 21:673 (1993)); genes encoding molecules that can stimulate signal transduction (see e.g., Botella et al., Plant Molec. Biol. 24:757 (1994), and Griess et al., Plant Physiol. 104:1467 (1994)); gene(s) encoding viral-invasive proteins or a complex toxin derived therefrom (Beachy et al., Ann. rev. Phytopathol. 28:451 (1990)); gene(s) encoding developmental-arrestive proteins produced in nature by a pathogen or a parasite see e.g., Lamb et al., Bio/Technology 10:1436 (1992) and Toubart et al., Plant J. 2:367 (1992)); gene(s) encoding a developmental-arrestive protein produced in nature by a plant (see e.g., Logemann et al., Bio/Technology 10:305 (1992)) and combinations thereof.

In plants, pathogens are often host-specific. For example, some *Fusarium* species will cause tomato wilt but attacks only tomato, and other *Fusarium* species attack only wheat. Plants have existing and induced defenses to resist most pathogens. Mutations and recombination events across plant generations lead to genetic variability that gives rise to susceptibility, especially as pathogens reproduce with more frequency than plants. In plants there can be non-host resistance, e.g., the host and pathogen are incompatible or there can be partial resistance against all races of a pathogen, typically controlled by many genes and/or also complete resistance to some races of a pathogen but not to other races. Such resistance is typically controlled by a few genes. Using methods and components of the CRISPR-Cas system, a new tool now exists to induce specific mutations in anticipation hereon. Accordingly, one can analyze the genome of sources of resistance genes, and in plants having desired characteristics or traits, use the method and components of the CRISPR-Cas system to induce the rise of resistance genes. The present systems can do so with more precision than previous mutagenic agents and hence accelerate and improve plant breeding programs.

In some embodiments, the plant or cell(s) thereof can be modified to contain one or more genes involved in plant diseases, such as those that confer resistance to one or more plant diseases, such as any one or more of those listed in PCT Publication WO 2013046247. Exemplary rice diseases/disease causing organisms that the modified plant can be resistant to are, without limitation, *Magnaporthe grisea, Cochliobolus miyabeanus, Rhizoctonia solani*, and *Gibberella fujikuroi*.

Exemplary wheat diseases/disease causing organisms that the modified plant can be resistant to are, without limitation, *Erysiphe graminis, Fusarium graminearum, F. avenaceum, F. culmorum, Microdochium nivale, Puccinia striiformis, P. graminis, P. recondita, Micronectriella nivale, Typhula* sp., *Ustilago tritici, Tilletia caries, Pseudocercosporella herpotrichoides, Mycosphaerella graminicola, Stagonospora nodorum*, and *Pyrenophora tritici-repentis*.

Exemplary barley diseases/disease causing organisms that the modified plant can be resistant to are, without limitation, *Erysiphe graminis, Fusarium graminearum, F. avenaceum, F. culmorum, Microdochium nivale, Puccinia striiformis, P. graminis, P. hordei, Ustilago nuda, Rhynchosporium secalis, Pyrenophora teres, Cochliobolus sativus, Pyrenophora graminea*, and *Rhizoctonia solani*.

Exemplary maize diseases/disease causing organisms that the modified plant can be resistant to are, without limitation, *Ustilago maydis, Cochliobolus heterostrophus, Gloeocercospora sorghi, Puccinia polysora, Cercospora zeae-maydis, Rhizoctonia solani*.

Exemplary citrus diseases/disease causing organisms that the modified plant can be resistant to are, without limitation, *Diaporthe citri, Elsinoe fawcetti, Penicillium digitatum, P. italicum, Phytophthora parasitica*, and *Phytophthora citrophthora*.

Exemplary apple diseases/disease causing organisms that the modified plant can be resistant to are, without limitation, *Monilinia mali, Valsa ceratosperma, Podosphaera leucotricha, Alternaria alternata* apple pathotype, *Venturia inaequalis, Colletotrichum acutatum, Phytophthora cactorum*.

Exemplary pear diseases/disease causing organisms that the modified plant can be resistant to are, without limitation, *Venturia nashicola, V. pirina, Alternaria alternata* Japanese pear pathotype, *Gymnosporangium haraeanum*, and *Phytophthora cactorum*.

Exemplary peach diseases/disease causing organisms that the modified plant can be resistant to are, without limitation, *Monilinia fructicola, Cladosporium carpophilum*, and *Phomopsis* sp.

Exemplary grape diseases/disease causing organisms that the modified plant can be resistant to are, without limitation, *Elsinoe ampelina, Glomerella cingulata, Uncinula necator, Phakopsora ampelopsidis, Guignardia bidwellii*, and *Plasmopara viticola*.

Exemplary persimmon diseases/disease causing organisms that the modified plant can be resistant to are, without limitation, *Gloeosporium kaki, Cercospora kaki*, and *Mycosphaerella nawae*.

Exemplary gourd diseases/disease causing organisms that the modified plant can be resistant to are, without limitation, *Colletotrichum lagenarium, Sphaerotheca fuliginea, Mycosphaerella melonis, Fusarium oxysporum, Pseudoperonospora cubensis*, and *Phytophthora* sp., *Pythium* sp.

Exemplary tomato diseases/disease causing organisms that the modified plant can be resistant to are, without limitation, *Alternaria solani, Cladosporium fulvum, Phytophthora infestans; Pseudomonas syringae* pv. Tomato; *Phytophthora capsici*; and *Xanthomonas*.

Exemplary eggplant diseases/disease causing organisms that the modified plant can be resistant to are, without limitation, *Phomopsis vexans* and *Erysiphe cichoracearum*.

Exemplary Brassicaceous vegetable diseases/disease causing organisms that the modified plant can be resistant to are, without limitation, *Alternaria japonica, Cercosporella brassicae, Plasmodiophora brassicae*, and *Peronospora parasitica*.

Exemplary Welsh onion diseases/disease causing organisms that the modified plant can be resistant to are, without limitation, *Puccinia allii* and *Peronospora destructor*.

Exemplary Welsh onion diseases/disease causing organisms that the modified plant can be resistant to are, without limitation *Cercospora kikuchii, Elsinoe glycines, Diaporthe phaseolorum* var. *sojae, Septoria glycines, Cercospora sojina, Phakopsora pachyrhizi, Phytophthora sojae, Rhizoctonia solani, Corynespora cassiicola*, and *Sclerotinia sclerotiorum*.

Exemplary kidney bean diseases/disease causing organisms that the modified plant can be resistant to are, without limitation, *Colletotrichum lindemuthianum*.

Exemplary peanut diseases/disease causing organisms that the modified plant can be resistant to are, without limitation, *Cercospora personata*, *Cercospora arachidicola*, and *Sclerotium rolfsii*.

Exemplary pea diseases/disease causing organisms that the modified plant can be resistant to are, without limitation, *Erysiphe pisi*.

Exemplary potato diseases/disease causing organisms that the modified plant can be resistant to are, without limitation, *Alternaria solani*, *Phytophthora infestans*, *Phytophthora erythroseptica*, *Spongospora subterranea*, and f. sp. *Subterranea*.

Exemplary strawberry diseases/disease causing organisms that the modified plant can be resistant to are, without limitation, *Sphaerotheca humuli* and *Glomerella cingulate*.

Exemplary tea diseases/disease causing organisms that the modified plant can be resistant to are, without limitation, *Exobasidium reticulatum*, *Elsinoe leucospila*, *Pestalotiopsis* sp., and *Colletotrichum theae-sinensis*.

Exemplary tobacco diseases/disease causing organisms that the modified plant can be resistant to are, without limitation, *Alternaria longipes*, *Erysiphe cichoracearum*, *Colletotrichum tabacum*, *Peronospora tabacina*, and *Phytophthora nicotianae*.

Exemplary rapeseed diseases/disease causing organisms that the modified plant can be resistant to are, without limitation, *Sclerotinia sclerotiorum*, and *Rhizoctonia solani*.

Exemplary cotton diseases/disease causing organisms that the modified plant can be resistant to are, without limitation, *Rhizoctonia solani*.

Exemplary beet diseases/disease causing organisms that the modified plant can be resistant to are, without limitation, *Cercospora beticola*, *Thanatephorus cucumeris*, and *Aphanomyces cochlioides*.

Exemplary rose diseases/disease causing organisms that the modified plant can be resistant to are, without limitation, *Diplocarpon rosae*, *Sphaerotheca pannosa*, and *Peronospora sparsa*.

Exemplary chrysanthemum and asteraceae diseases/disease causing organisms that the modified plant can be resistant to are, without limitation, *Bremia lactucae*, *Septoria chrysanthemi-indici*, and *Puccinia horiana*.

Exemplary radish diseases/disease causing organisms that the modified plant can be resistant to are, without limitation, *Alternaria brassicicola*.

Exemplary *zoysia* diseases/disease causing organisms that the modified plant can be resistant to are, without limitation, *Sclerotinia homoeocarpa*, and *Rhizoctonia solani*.

Exemplary banana diseases/disease causing organisms that the modified plant can be resistant to are, without limitation, *Mycosphaerella fijiensis* and *Mycosphaerella musicola*.

Exemplary sunflower diseases/disease causing organisms that the modified plant can be resistant to are, without limitation, and *Plasmopara halstedii*.

Exemplary seed or initial stage of plant growth diseases/disease causing organisms that the modified plant can be resistant to are, without limitation, *Aspergillus* spp., *Penicillium* spp., *Fusarium* spp., *Gibberella* spp., *Trichoderma* spp., *Thielaviopsis* spp., *Rhizopus* spp., *Mucor* spp., *Corticium* spp., *Rhoma* spp., *Rhizoctonia* spp., *Diplodia* spp., and the like.

Other exemplary diseases/disease causing organisms that the modified plant can be resistant to are, without limitation, *Pythium aphanidermatum*, *Pythium debaryanum*, *Pythium graminicola*, *Pythium irregulare*, *Pythium ultimum*, *Botrytis cinerea*, *Sclerotinia sclerotiorum*, *Polymyxa* spp., *Olpidium* spp.

Genes that Confer Resistance to Herbicides

In some embodiments, the CRISPR-Cas systems described herein can be used to modify a plant or cell thereof such that the modified plant or cell thereof contains one or more genes that confer herbicide resistance to the plant.

In some embodiments, the modified plant or cell thereof can contain one or more genes that confer resistance to herbicides that inhibit the growing point or meristem, such as an imidazolinone or a sulfonylurea, for example, by Lee et al., EMBO J. 7:1241 (1988), and Miki et al., Theor. Appl. Genet. 80:449 (1990), respectively.

In some embodiments, the modified plant or cell thereof can contain one or more genes that confer glyphosate tolerance (e.g., mutant 5-enolpyruvylshikimate-3-phosphate synthase (EPSPs) genes, aroA genes and glyphosate acetyl transferase (GAT) genes, respectively), or resistance to other phosphono compounds such as by glufosinate (e.g., phosphinothricin acetyl transferase (PAT) genes from *Streptomyces* species, including *Streptomyces hygroscopicus* and *Streptomyces viridochromogenes*), and to pyridinoxy or phenoxy propionic acids and cyclohexones (e.g., ACCase inhibitor-encoding genes. See, for example, U.S. Pat. Nos. 4,940,835 and 6,248,876, U.S. Pat. No. 4,769,061, EP No. 0 333 033 and U.S. Pat. No. 4,975,374. See also EP No. 0242246, DeGreef et al., Bio/Technology 7:61 (1989), Marshall et al., Theor. Appl. Genet. 83:435 (1992), and WO 2005012515 to Castle et. al. and WO 2005107437).

In some embodiments, the modified plant or cell thereof can contain one or more genes that confer resistance to herbicides that inhibit photosynthesis, such as a triazine (e.g., psbA and gs+ genes) or a benzonitrile (e.g., nitrilase gene), and glutathione S-transferase in Przibila et al., Plant Cell 3:169 (1991), U.S. Pat. No. 4,810,648, and Hayes et al., Biochem. J. 285: 173 (1992).

In some embodiments, the modified plant or cell thereof can contain one or more genes encoding enzymes that can detoxify a herbicide or a mutant glutamine synthase enzyme that is resistant to inhibition, e.g. n U.S. patent application Ser. No. 11/760,602. Or a detoxifying enzyme is an enzyme encoding a phosphinothricin acetyltransferase (such as the bar or pat protein from *Streptomyces* species). Phosphinothricin acetyltransferases are for example described in U.S. Pat. Nos. 5,561,236; 5,648,477; 5,646,024; 5,273,894; 5,637,489; 5,276,268; 5,739,082; 5,908,810 and 7,112,665.

In some embodiments, the modified plant or cell thereof can contain one or more genes encoding hydroxyphenylpyruvatedioxygenases (HPPD) inhibitors, i.e., naturally occurring HPPD resistant enzymes, or genes encoding a mutated or chimeric HPPD enzyme as described in WO 96/38567, WO 99/24585, and WO 99/24586, WO 2009/144079, WO 2002/046387, or U.S. Pat. No. 6,768,044.

Genes Involved in Abiotic Stress Tolerance

In some embodiments, the CRISPR-Cas systems described herein can be used to modify a plant or a cell thereof such that the modified or cell thereof plant contains one or more genes that confer abiotic stress tolerance to the plant.

In some embodiments, the modified plant or cell thereof can contain one or more transgenes capable of reducing the expression and/or the activity of poly(ADP-ribose) polymerase (PARP) gene in the plant cells or plants as described in WO 00/04173 or WO/2006/045633.

In some embodiments, the modified plant or cell thereof can contain one or more transgenes capable of reducing the expression and/or the activity of the PARG encoding genes of the plants or plants cells, as described e.g. in WO 2004/090140.

In some embodiments, the modified plant or cell thereof can contain one or more transgenes coding for a plant-functional enzyme of the nicotinamide adenine dinucleotide salvage synthesis pathway including nicotinamidase, nicotinate phosphoribosyltransferase, nicotinic acid mononucleotide adenyl transferase, nicotinamide adenine dinucleotide synthetase or nicotine amide phosphoribosyltransferase as described e.g. in EP 04077624.7, WO 2006/133827, PCT/EP07/002,433, EP 1999263, or WO 2007/107326.

In some embodiments, the modified plant or cell thereof can be modified to contain one or more genes encoding enzyme(s) involved in carbohydrate biosynthesis. Such enzymes include those described in e.g. EP 0571427, WO 95/04826, EP 0719338, WO 96/15248, WO 96/19581, WO 96/27674, WO 97/11188, WO 97/26362, WO 97/32985, WO 97/42328, WO 97/44472, WO 97/45545, WO 98/27212, WO 98/40503, WO99/58688, WO 99/58690, WO 99/58654, WO 00/08184, WO 00/08185, WO 00/08175, WO 00/28052, WO 00/77229, WO 01/12782, WO 01/12826, WO 02/101059, WO 03/071860, WO 2004/056999, WO 2005/030942, WO 2005/030941, WO 2005/095632, WO 2005/095617, WO 2005/095619, WO 2005/095618, WO 2005/123927, WO 2006/018319, WO 2006/103107, WO 2006/108702, WO 2007/009823, WO 00/22140, WO 2006/063862, WO 2006/072603, WO 02/034923, EP 06090134.5, EP 06090228.5, EP 06090227.7, EP 07090007.1, EP 07090009.7, WO 01/14569, WO 02/79410, WO 03/33540, WO 2004/078983, WO 01/19975, WO 95/26407, WO 96/34968, WO 98/20145, WO 99/12950, WO 99/66050, WO 99/53072, U.S. Pat. No. 6,734,341, WO 00/11192, WO 98/22604, WO 98/32326, WO 01/98509, WO 01/98509, WO 2005/002359, U.S. Pat. Nos. 5,824,790, 6,013,861, WO 94/04693, WO 94/09144, WO 94/11520, WO 95/35026 or WO 97/20936. In some embodiments, the modified plant or cell thereof can be modified to contain one or more genes encoding enzyme(s) involved in the production of polyfructose, especially of the inulin and levan-type, as disclosed in EP 0663956, WO 96/01904, WO 96/21023, WO 98/39460, and WO 99/24593. In some embodiments, the modified plant or cell thereof can be modified to contain one or more genes encoding enzyme(s) involved in the production of alpha-1, 4-glucans as disclosed in WO 95/31553, US 2002031826, U.S. Pat. Nos. 6,284,479, 5,712,107, WO 97/47806, WO 97/47807, WO 97/47808 and WO 00/14249. In some embodiments, the modified plant or cell thereof can be modified to contain one or more genes encoding enzyme(s) involved in the production of alpha-1,6 branched alpha-1, 4-glucans, as disclosed in WO 00/73422, the production of alternan, as disclosed in e.g. WO 00/47727, WO 00/73422, EP 06077301.7, U.S. Pat. No. 5,908,975 and EP 0728213. In some embodiments, the modified plant or cell thereof can be modified to contain one or more genes encoding enzyme(s) involved in the production of hyaluronan, as for example disclosed in WO 2006/032538, WO 2007/039314, WO 2007/039315, WO 2007/039316, JP 2006304779, and WO 2005/012529.

In some embodiments, the modified plant or cell thereof can be modified to contain one or more genes that improve drought resistance. For example, International Patent Publication No. WO 2013122472 discloses that the absence or reduced level of functional Ubiquitin Protein Ligase protein (UPL) protein, more specifically, UPL3, leads to a decreased need for water or improved resistance to drought of said plant. In some embodiments, the modified plant or cell thereof can be modified to contain one or more genes that cause the absence or reduced level of functional Ubiquitin Protein Ligase protein (UPL) protein, more specifically, UPL3. In some embodiments, this can include knocking out a UPL gene, such as UPL3.

Other examples of transgenic plants with increased drought tolerance are disclosed in, for example, US 2009/0144850, US 2007/0266453, and WO 2002/083911. US2009/0144850 describes a plant displaying a drought tolerance phenotype due to altered expression of a DR02 nucleic acid. US 2007/0266453 describes a plant displaying a drought tolerance phenotype due to altered expression of a DR03 nucleic acid and WO 2002/083911 describes a plant having an increased tolerance to drought stress due to a reduced activity of an ABC transporter which is expressed in guard cells. Another example is the work by Kasuga and co-authors (1999), who describe that overexpression of cDNA encoding DREB1 A in transgenic plants activated the expression of many stress tolerance genes under normal growing conditions and resulted in improved tolerance to drought, salt loading, and freezing. However, the expression of DREB1A also resulted in severe growth retardation under normal growing conditions (Kasuga (1999) Nat Biotechnol 17(3) 287-291). In some embodiments, the CRISPR-Cas systems described herein can be used to modify a plant to contain any of these genes associated with drought tolerance.

Increasing the Fertility Stage in Plants

The CRISPR-Cas systems described herein can be used to generate male sterile plants. Hybrid plants typically have advantageous agronomic traits compared to inbred plants. However, for self-pollinating plants, the generation of hybrids can be challenging. In different plant types, genes have been identified which are important for plant fertility, more particularly male fertility. For instance, in maize, at least two genes have been identified which are important in fertility (Amitabh Mohanty International Conference on New Plant Breeding Molecular Technologies Technology Development and Regulation, Oct. 9-10, 2014, Jaipur, India; Svitashev et al. Plant Physiol. 2015 October; 169(2):931-45; Djukanovic et al. Plant J. 2013 December; 76(5):888-99). The methods provided herein can be used to target genes required for male fertility so as to generate male sterile plants which can easily be crossed to generate hybrids. In particular embodiments, the CRISPR-Cas system provided herein is used for targeted mutagenesis of the cytochrome P450-like gene (MS26) or the meganuclease gene (MS45) thereby conferring male sterility to the maize plant. Maize plants which are as such genetically altered can be used in hybrid breeding programs.

In particular embodiments, the methods provided herein are used to prolong the fertility stage of a plant such as of a rice plant. For instance, a rice fertility stage gene such as Ehd3 can be targeted in order to generate a mutation in the gene and plantlets can be selected for a prolonged regeneration plant fertility stage (as described in CN 104004782).

Generating Genetic Variation

The CRISPR-Cas systems described herein can be used to generate genetic variation in a crop of interest. The availability of wild germplasm and genetic variations in crop plants is the key to crop improvement programs, but the available diversity in germplasms from crop plants is limited. The present invention envisages methods for generating a diversity of genetic variations in a germplasm of interest. In this application of the CRISPR-Cas system a library of guide RNAs targeting different locations in the plant genome is provided and is introduced into plant cells together with the Cas (e.g., a small Type II-D Cas protein or variant thereof) effector protein(s). In this way a collection of genome-scale point mutations and gene knock-outs can be generated. In particular embodiments, the methods comprise generating a plant part or plant from the cells so obtained and screening the cells for a trait of interest. The target genes can include both coding and non-coding regions. In particular embodiments, the trait is stress tolerance and the method is a method for the generation of stress-tolerant crop varieties.

Modulating Fruit Ripening

The CRISPR Cas systems described herein can be used to affect fruit-ripening. Ripening is a normal phase in the maturation process of fruits and vegetables. Only a few days after it starts it renders a fruit or vegetable inedible. This process brings significant losses to both farmers and consumers. In some embodiments the CRISPR-Cas systems described herein can be used to introduce one or more genes or modify one or more endogenous genes such that ethylene production is altered, such as decreased. In some embodiments, CRISPR-Cas systems described herein can be used to introduce one or more genes or modify one or more endogenous genes such that ACC (1-aminocyclopropane-1-carboxylic acid) synthase gene expression or ACC synthase levels are reduced and/or its function is altered, e.g., reduced. ACC synthase is the enzyme responsible for the conversion of S-adenosylmethionine (SAM) to ACC; the second to the last step in ethylene biosynthesis. In some embodiments, the CRISPR-Cas systems described herein can be used to introduce an antisense ("mirror-image") or truncated copy of the ACC synthase gene into the plant's genome.

In some embodiments, reduction of ethylene production can be achieved by introducing an ACC deaminase. In some embodiments, the CRISPR-Cas systems described herein can be used to introduce an ACC deaminase gene into the plant's genome. An exemplary ACC deaminase gene can be that from *Pseudomonas chlororaphis*, a common nonpathogenic soil bacterium. It converts ACC to a different compound thereby reducing the amount of ACC available for ethylene production.

In some embodiments, reduction of ethylene production can be achieved by introducing a SAM hydrolase. In some embodiments, the CRISPR-Cas systems described herein can introduce a SAM hydrolase gene into the plant's genome. This approach is similar to ACC deaminase wherein ethylene production is hindered when the amount of its precursor metabolite is reduced; in this case SAM is converted to homoserine. In some embodiments the gene encoding the SAM hydrolase is from *E. coli* T3 bacteriophage.

In some embodiments, reduction of ethylene production can be achieved by suppression of ACC oxidase. In some embodiments, the CRISPR-Cas systems described herein can be used to introduce one or more genes that result in and suppression of ACC oxidase gene expression. ACC oxidase is the enzyme which catalyzes the oxidation of ACC to ethylene, the last step in the ethylene biosynthetic pathway. Using the methods described herein, down regulation of the ACC oxidase gene results in the suppression of ethylene production, thereby delaying fruit ripening.

In particular embodiments, additionally or alternatively to the modifications described above, the methods and CRISPR-Cas systems described herein are used to modify ethylene receptors, so as to interfere with ethylene signals obtained by the fruit. In particular embodiments, the CRISPR-Cas systems described herein are used to introduce and/or modify one or more genes that result in altered, and more specifically decreased or suppressed, expression of the ETR1 gene, encoding an ethylene binding protein is modified. In particular embodiments, additionally or alternatively to the modifications described above, the methods and CRISPR-Cas systems described herein are used to modify expression of the gene encoding Polygalacturonase (PG), which is the enzyme responsible for the breakdown of pectin, the substance that maintains the integrity of plant cell walls. Pectin breakdown occurs at the start of the ripening process resulting in the softening of the fruit. Accordingly, in particular embodiments, the methods and CRISPR-Cas systems described herein are used to introduce a mutation in the PG gene or to suppress activation of the PG gene in order to reduce the amount of PG enzyme produced thereby delaying pectin degradation.

Increasing Storage Life of Plants and Plant Products

In particular embodiments, the methods and CRISPR-Cas systems described herein are used to modify one or more genes involved in the production of compounds which affect storage life of the plant or plant part. In some embodiments, the modification is in a gene that prevents the accumulation of reducing sugars in potato tubers. Upon high-temperature processing, these reducing sugars react with free amino acids, resulting in brown, bitter-tasting products and elevated levels of acrylamide, which is a potential carcinogen. In particular embodiments, the methods and CRISPR-Cas systems provided herein are used to reduce or inhibit expression of the vacuolar invertase gene (VInv), which encodes a protein that breaks down sucrose to glucose and fructose (Clasen et al. DOI: 10.1111/pbi.12370).

Nutritionally Improved Plants

In particular embodiments, the CRISPR-Cas system described herein is used to produce nutritionally improved agricultural crops. In particular embodiments, the methods provided herein are adapted to generate "functional foods", i.e. a modified food or food ingredient that may provide a health benefit beyond the traditional nutrients it contains and/or "nutraceutical", i.e. substances that may be considered a food or part of a food and provides health benefits, including the prevention and treatment of disease. In particular embodiments, the nutraceutical is useful in the prevention and/or treatment of one or more of cancer, diabetes, cardiovascular disease, and hypertension.

Examples of nutritionally improved crops include, but are not limited to, those discussed in Newell-McGloughlin, Plant Physiology, July 2008, Vol. 147, pp. 939-953). In some embodiments, the CRISPR-Cas systems described herein can be used to modify a plant's protein quality, content and/or amino acid composition, such as have been described for Bahiagrass (Luciani et al. 2005, Florida Genetics Conference Poster), Canola (Roesler et al., 1997, Plant Physiol 113 75-81), Maize (Cromwell et al, 1967, 1969 J Anim Sci 26 1325-1331, O'Quin et al. 2000 J Anim Sci 78 2144-2149, Yang et al. 2002, Transgenic Res 11 11-20, Young et al. 2004, Plant J 38 910-922), Potato (Yu J and Ao, 1997 Acta Bot Sin 39 329-334; Chakraborty et al. 2000, Proc Natl Acad Sci USA 97 3724-3729; Li et al. 2001) Chin Sci Bull 46 482-484, Rice (Katsube et al. 1999, Plant Physiol 120 1063-1074), Soybean (Dinkins et al. 2001, Rapp 2002, In vitro Cell Dev Biol Plant 37 742-747), Sweet Potato (Egnin and Prakash 1997, In vitro Cell Dev Biol 33 52A).

In some embodiments, the CRISPR-Cas systems described herein can be used to modify a plant's essential amino acid content, such as has been described for Canola (Falco et al. 1995, Bio/Technology 13 577-582), Lupin (White et al. 2001, J Sci Food Agric 81 147-154), Maize (Lai and Messing, 2002, Agbios 2008 GM crop database (Mar. 11, 2008)), Potato (Zeh et al. 2001, Plant Physiol 127 792-802), Sorghum (Zhao et al. 2003, Kluwer Academic Publishers, Dordrecht, The Netherlands, pp 413-416), Soybean (Falco et al. 1995 Bio/Technology 13 577-582; Galili et al. 2002 Crit Rev Plant Sci 21 167-204).

In some embodiments, the CRISPR-Cas systems described herein can be used to modify a plant's oils and fatty acids, such as for Canola (Dehesh et al. (1996) Plant J 9 167-172 [PubMed]; Del Vecchio (1996) INFORM International News on Fats, Oils and Related Materials 7 230-243; Roesler et al. (1997) Plant Physiol 113 75-81 [PMC free article] [PubMed]; Froman and Ursin (2002, 2003) Abstracts of Papers of the American Chemical Society 223 U35; James et al. (2003) Am J Clin Nutr 77 1140-1145 [PubMed]; Agbios (2008, above); cotton (Chapman et al. (2001). J Am Oil Chem Soc 78 941-947; Liu et al. (2002) J Am Coll Nutr 21 205S-211S [PubMed]; O'Neill (2007) Australian Life Scientist. http://www.biotechnews.com.au/index.php/id; 866694817;fp;4;fpid;2 (Jun. 17, 2008), Linseed (Abbadi et al., 2004, Plant Cell 16: 2734-2748), Maize (Young et al., 2004, Plant J 38 910-922), oil palm (Jalani et al. 1997, J Am Oil Chem Soc 74 1451-1455; Parveez, 2003, AgBiotechNet 113 1-8), Rice (Anai et al., 2003, Plant Cell Rep 21 988-992), Soybean (Reddy and Thomas, 1996, Nat Biotechnol 14 639-642; Kinney and Kwolton, 1998, Blackie Academic and Professional, London, pp 193-213), Sunflower (Arcadia, Biosciences 2008).

In some embodiments, the CRISPR-Cas systems described herein can be used to modify a plant's carbohydrate content, such as Fructans described for Chicory (Smeekens (1997) Trends Plant Sci 2 286-287, Sprenger et al. (1997) FEBS Lett 400 355-358, Sévenier et al. (1998) Nat Biotechnol 16 843-846), Maize (Caimi et al. (1996) Plant Physiol 110 355-363), Potato (Hellwege et al., 1997 Plant J 12 1057-1065), Sugar Beet (Smeekens et al. 1997, above), Inulin, such as described for Potato (Hellewege et al. 2000, Proc Natl Acad Sci USA 97 8699-8704), Starch, such as described for Rice (Schwall et al. (2000) Nat Biotechnol 18 551-554, Chiang et al. (2005) Mol Breed 15 125-143).

In some embodiments, the CRISPR-Cas systems described herein can be used to modify a plant's vitamins and carotenoid content, such as described for Canola (Shintani and DellaPenna (1998) Science 282 2098-2100), Maize (Rocheford et al. (2002). J Am Coll Nutr 21 191S-198S, Cahoon et al. (2003) Nat Biotechnol 21 1082-1087, Chen et al. (2003) Proc Natl Acad Sci USA 100 3525-3530), Mustardseed (Shewmaker et al. (1999) Plant J 20 401-412, Potato (Ducreux et al., 2005, J Exp Bot 56 81-89), Rice (Ye et al. (2000) Science 287 303-305, Strawberry (Agius et al. (2003), Nat Biotechnol 21 177-181), Tomato (Rosati et al. (2000) Plant J 24 413-419, Fraser et al. (2001) J Sci Food Agric 81 822-827, Mehta et al. (2002) Nat Biotechnol 20 613-618, Diaz de la Garza et al. (2004) Proc Natl Acad Sci USA 101 13720-13725, Enfissi et al. (2005) Plant Biotechnol J 3 17-27, DellaPenna (2007) Proc Natl Acad Sci USA 104 3675-3676.

In some embodiments, the CRISPR-Cas systems described herein can be used to modify a plant's functional secondary metabolites, such as described for Apple (stilbenes, Szankowski et al. (2003) Plant Cell Rep 22: 141-149), Alfalfa (resveratrol, Hipskind and Paiva (2000) Mol Plant Microbe Interact 13 551-562), Kiwi (resveratrol, Kobayashi et al. (2000) Plant Cell Rep 19 904-910), Maize and Soybean (flavonoids, Yu et al. (2000) Plant Physiol 124 781-794), Potato (anthocyanin and alkaloid glycoside, Lukaszewicz et al. (2004) J Agric Food Chem 52 1526-1533), Rice (flavonoids & resveratrol, Stark-Lorenzen et al. (1997) Plant Cell Rep 16 668-673, Shin et al. (2006) Plant Biotechnol J 4 303-315), Tomato (+resveratrol, chlorogenic acid, flavonoids, stilbene; Rosati et al. (2000) above, Muir et al. (2001) Nature 19 470-474, Niggeweg et al. (2004) Nat Biotechnol 22 746-754, Giovinazzo et al. (2005) Plant Biotechnol J 3 57-69), wheat (caffeic and ferulic acids, resveratrol; United Press International (2002)).

In some embodiments, the CRISPR-Cas systems described herein can be used to modify a plant's mineral availabilities and/or content such as described for Alfalfa (phytase, Austin-Phillips et al. (1999) http://www.molecularfarming.com/nonmedical.html), Lettuce (iron, Goto et al. (2000) Theor Appl Genet 100 658-664), Rice (iron, Lucca et al. (2002) J Am Coll Nutr 21 184S-190S), Maize, Soybean and wheat (phytase, Drakakaki et al. (2005) Plant Mol Biol 59 869-880, Denbow et al. (1998) Poult Sci 77 878-881, Brinch-Pedersen et al. (2000) Mol Breed 6 195-206).

In particular embodiments, the value-added trait is related to the envisaged health benefits of the compounds present in the plant. For instance, in particular embodiments, the value-added crop is obtained by applying the methods and CRISPR-Cas systems described herein to modify and/or induce/increase the synthesis of one or more of the following compounds:

a) Carotenoids, such as α-Carotene present in carrots which neutralizes free radicals that may cause damage to cells or β-Carotene present in various fruits and vegetables which neutralizes free radicals;
b) Lutein, such as that present in green vegetables which contributes to maintenance of healthy vision;
c) Lycopene present in tomato and tomato products, which is believed to reduce the risk of prostate cancer;
d) Zeaxanthin, present in citrus and maize, which contributes to maintenance of healthy vision;
e) dietary fiber, such as insoluble fiber present in wheat bran which may reduce the risk of breast and/or colon cancer and β-Glucan present in oat, soluble fiber present in *Psyllium* and whole cereal grains which may reduce the risk of cardiovascular disease (CVD).
f) Fatty acids, such as ω-3 fatty acids which may reduce the risk of CVD and improve mental and visual functions, conjugated linoleic acid, which may improve body composition, may decrease risk of certain cancers and GLA which may reduce inflammation risk of cancer and CVD, may improve body composition;
g) Flavonoids, such as Hydroxycinnamates, present in wheat which have Antioxidant-like activities, may reduce risk of degenerative diseases, flavonols, catechins and tannins present in fruits and vegetables which neutralize free radicals and may reduce risk of cancer;
h) Glucosinolates, indoles, and isothiocyanates, such as Sulforaphane, present in Cruciferous vegetables (broccoli, kale, and horseradish), which neutralize free radicals, may reduce risk of cancer;
i) phenolics, such as stilbenes present in grape (may reduce risk of degenerative diseases, heart disease, and cancer, may have longevity effect), caffeic acid and ferulic acid present in vegetables and citrus (have antioxidant-like activities and may reduce risk of degenerative diseases, heart disease, and eye disease), and epicatechin present in cacao (has antioxidant-like activities and may reduce risk of degenerative diseases and heart disease);
j) Plant stanols/sterols present in maize, soy, wheat and wooden oils, which may reduce risk of coronary heart disease by lowering blood cholesterol levels;
k) Fructans, inulins, fructo-oligosaccharides present in Jerusalem artichoke, shallot, onion powder, which may improve gastrointestinal health;
l) saponins present in soybean, which may lower LDL cholesterol;
m) soybean protein present in soybean, which may reduce risk of heart disease;
n) phytoestrogens such as isoflavones present in soybean, which may reduce menopause symptoms, such as hot flashes, may reduce osteoporosis and CVD and lignans present in flax, rye and vegetables, which may protect against heart disease and some cancers, may lower LDL cholesterol, total cholesterol;
o) sulfides and thiols such as diallyl sulphide present in onion, garlic, olive, leek and scallions and Allyl methyl trisulfide, dithiolthiones present in cruciferous vegetables, which may lower LDL cholesterol and helps to maintain healthy immune system; and
p) tannins, such as proanthocyanidins, present in cranberry, cocoa, which may improve urinary tract health and may reduce risk of CVD and high blood pressure.

In addition, the methods and CRISPR-Cas systems described herein can be used to modify the protein/starch functionality, shelf life, taste/aesthetics, fiber quality, and allergen, antinutrient, and toxin reduction traits of a plant or a cell thereof.

In some embodiments, a method of using the CRISPR-Cas systems described herein to produce plants with nutritional added value can include introducing into a plant cell a gene encoding an enzyme involved in the production of a component of added nutritional value using the CRISPR-Cas system as described herein and regenerating a plant from said plant cell, said plant characterized in an increase expression of said component of added nutritional value. In particular embodiments, the CRISPR-Cas system is used to modify the endogenous synthesis of these compounds indirectly, e.g. by modifying one or more transcription factors that controls the metabolism of this compound. Methods for introducing a gene of interest into a plant cell and/or modifying an endogenous gene using the CRISPR-Cas system are described elsewhere herein.

Some specific examples of modifications in plants that have been modified to confer value-added traits are: plants with modified fatty acid metabolism, for example, by transforming a plant with an antisense gene of stearyl-ACP desaturase to increase stearic acid content of the plant. See Knultzon et al., Proc. Natl. Acad. Sci. U.S.A. 89:2624 (1992). Another example involves decreasing phytate content, for example by cloning and then reintroducing DNA associated with the single allele which may be responsible for maize mutants characterized by low levels of phytic acid. See Raboy et al, Maydica 35:383 (1990).

Similarly, expression of the maize (Zea mays) Tfs C1 and R, which regulate the production of flavonoids in maize aleurone layers under the control of a strong promoter, resulted in a high accumulation rate of anthocyanins in Arabidopsis (Arabidopsis thaliana), presumably by activating the entire pathway (Bruce et al., 2000, Plant Cell 12:65-80). DellaPenna (Welsch et al., 2007 Annu Rev Plant Biol 57: 711-738) found that Tf RAP2.2 and its interacting partner SINAT2 increased carotenogenesis in Arabidopsis leaves. Expressing the Tf Dof1 induced the up-regulation of genes encoding enzymes for carbon skeleton production, a marked increase of amino acid content, and a reduction of the Glc level in transgenic Arabidopsis (Yanagisawa, 2004 Plant Cell Physiol 45: 386-391), and the DOF Tf AtDof1.1 (OBP2) up-regulated all steps in the glucosinolate biosynthetic pathway in Arabidopsis (Skirycz et al., 2006 Plant J 47: 10-24).

Reducing Allergen in Plants

In particular embodiments, the methods and CRISPR-Cas systems described herein can be used to generate plants with a reduced level of allergens, making them safer for the consumer. In particular embodiments, the methods can include modifying expression of one or more genes responsible for the production of plant allergens. For instance, in particular embodiments, the methods comprise down-regulating expression of a Lol p5 gene in a plant cell, such as a ryegrass plant cell and regenerating a plant therefrom so as to reduce allergenicity of the pollen of said plant (Bhalla et al. 1999, Proc. Natl. Acad. Sci. USA Vol. 96: 11676-11680).

Peanut allergies and allergies to legumes generally are a real and serious health concern. The Cas (e.g., small Type II-D Cas) effector protein system of the present invention can be used to identify and then edit or silence genes encoding allergenic proteins of such legumes. Without limitation as to such genes and proteins, Nicolaou et al. identifies allergenic proteins in peanuts, soybeans, lentils, peas, lupin, green beans, and mung beans. See, Nicolaou et al., Current Opinion in Allergy and Clinical Immunology 2011; 11(3): 222).

Further Applications of the CRISPR-Cas Systems in Plants

In particular embodiments, the CRISPR-Cas system described herein, can be used for visualization of genetic element dynamics. For example, CRISPR-Cas imaging can visualize either repetitive or non-repetitive genomic sequences, report telomere length change and telomere movements and monitor the dynamics of gene loci throughout the cell cycle (see e.g., Chen et al., Cell, 2013). These methods may also be applied to plants using the CRISPR-Cas systems described herein.

In some embodiments, the CRISPR-Cas systems described herein can be used for targeted gene disruption positive-selection screening in vitro and in vivo (see e.g., Malina et al., Genes and Development, 2013). These methods may also be applied to plants.

In particular embodiments, fusion of inactive Cas (e.g., a small Type II-D Cas protein or variant thereof) endonucleases with histone-modifying enzymes can introduce custom changes in the complex epigenome (see e.g., Rusk et al., Nature Methods, 2014). These methods may also be applied to plants.

In particular embodiments, the CRISPR-Cas systems described herein can be used to purify a specific portion of the chromatin and identify the associated proteins, thus elucidating their regulatory roles in transcription (e.g., Waldrip et al., Epigenetics, 2014). These methods may also be applied to plants.

In particular embodiments, present invention can be used as a therapy for virus removal in plant systems as it is able to cleave both viral DNA and RNA. Previous studies in human systems have demonstrated the success of utilizing CRISPR in targeting the single strand RNA virus, hepatitis C (see e.g., A. Price, et al., Proc. Natl. Acad. Sci, 2015) as well as the double stranded DNA virus, hepatitis B (see e.g., V. Ramanan, et al., Sci. Rep, 2015). These methods may also be adapted for using the CRISPR-Cas system described herein in plants.

In particular embodiments, the CRISPR-Cas systems described can be used to alter genome complexity. In further particular embodiment, the CRISPR system, and preferably the CRISPR-Cas system described herein, can be used to disrupt or alter chromosome number and generate haploid plants, which only contain chromosomes from one parent. Such plants can be induced to undergo chromosome duplication and converted into diploid plants containing only homozygous alleles (see e.g., Karimi-Ashtiyani et al., PNAS, 2015; Anton et al., Nucleus, 2014). These methods may also be applied to plants.

In particular embodiments, the CRISPR-Cas system described herein, can be used for self-cleavage. In these embodiments, the promotor of the Cas (e.g., a small Type II-D Cas protein or variant thereof) enzyme(s) and gRNA can be a constitutive promotor and a second gRNA is introduced in the same transformation cassette but controlled by an inducible promoter. This second gRNA can be designated to induce site-specific cleavage in the Cas (e.g., a small Type II-D Cas protein or variant thereof) gene in order to create a non-functional Cas (e.g., a small Type II-D Cas protein or variant thereof) protein(s). In a further particular embodiment, the second gRNA induces cleavage on both ends of the transformation cassette, resulting in the removal of the cassette from the host genome. This system offers a controlled duration of cellular exposure to the Cas enzyme and further minimizes off-target editing. Furthermore, cleavage of both ends of a CRISPR/Cas cassette can be used to generate transgene-free TO plants with bi-allelic mutations (as described for Cas9 e.g., Moore et al., Nucleic Acids Research, 2014; Schaeffer et al., Plant Science, 2015). The methods of Moore et al. may be applied to the small Type II-D CRISPR-Cas systems described herein.

Sugano et al. (Plant Cell Physiol. 2014 March; 55(3):475-81. doi: 10.1093/pcp/pcu014. Epub 2014 Jan. 18) reports the application of CRISPR-Cas9 to targeted mutagenesis in the liverwort Marchantia polymorpha L., which has emerged as a model species for studying land plant evolution. The U6 promoter of M. polymorpha was identified and cloned to express the gRNA. The target sequence of the gRNA was designed to disrupt the gene encoding auxin response factor 1 (ARF1) in M. polymorpha. Using Agrobacterium-mediated transformation, Sugano et al. isolated stable mutants in the gametophyte generation of M. polymorpha. CRISPR-Cas9-based site-directed mutagenesis in vivo was achieved using either the Cauliflower mosaic virus 35S or M. polymorpha EF1α promoter to express Cas9. Isolated mutant individuals showing an auxin-resistant phenotype were not chimeric. Moreover, stable mutants were produced by asexual reproduction of T1 plants. Multiple arf1 alleles were easily established using CRIPSR-Cas9-based targeted mutagenesis. The methods of Sugano et al. may be applied to the small Type II-D CRISPR-Cas systems described herein.

Ling et al. (BMC Plant Biology 2014, 14:327) developed a CRISPR-Cas9 binary vector set based on the pGreen or pCAMBIA backbone, as well as a gRNA This toolkit requires no restriction enzymes besides BsaI to generate final constructs harboring maize-codon optimized Cas9 and one or more gRNAs with high efficiency in as little as one cloning step. The toolkit was validated using maize protoplasts, transgenic maize lines, and transgenic Arabidopsis lines and was shown to exhibit high efficiency and specificity. Using this toolkit, targeted mutations of three Arabidopsis genes were detected in transgenic seedlings of the T1 generation. The multiple-gene mutations could be inherited by the next generation. (guide RNA) module vector set, as a toolkit for multiplex genome editing in plants. The toolbox of Lin et al. may be applied to the small Type II-D CRISPR-Cas systems described herein.

Protocols for targeted plant genome editing via CRISPR-Cas systems described herein are also available based on those disclosed for the CRISPR-Cas9 system in volume 1284 of the series Methods in Molecular Biology pp 239-255 10 Feb. 2015. A detailed procedure to design, construct, and evaluate dual gRNAs for plant codon optimized Cas9 (pcoCas9) mediated genome editing using Arabidopsis thaliana and Nicotiana benthamiana protoplasts s model cellular systems are described. Strategies to apply the CRISPR-Cas9 system to generating targeted genome modifications in whole plants are also discussed. The protocols described in the chapter may be applied to the small Type II-D CRISPR-Cas systems described herein.

Ma et al. (Mol Plant. 2015 Aug. 3; 8(8):1274-84. doi: 10.1016/j.molp.2015.04.007) reports robust CRISPR-Cas9 vector system, utilizing a plant codon optimized Cas9 gene, for convenient and high-efficiency multiplex genome editing in monocot and dicot plants. Ma et al. designed PCR-based procedures to rapidly generate multiple sgRNA expression cassettes, which can be assembled into the binary CRISPR-Cas9 vectors in one round of cloning by Golden Gate ligation or Gibson Assembly. With this system, Ma et al. edited 46 target sites in rice with an average 85.4% rate of mutation, mostly in biallelic and homozygous status. Ma et al. provide examples of loss-of-function gene mutations in TO rice and T1 Arabidopsis plants by simultaneous targeting of multiple (up to eight) members of a gene family, multiple genes in a biosynthetic pathway, or multiple sites in a single gene. The methods of Ma et al. may be applied to the small Type II-D CRISPR-Cas systems described herein.

Lowder et al. (Plant Physiol. 2015 Aug. 21. pii: pp. 00636.2015) developed a CRISPR-Cas9 toolbox that allows for multiplex genome editing and transcriptional regulation of expressed, silenced or non-coding genes in plants. This toolbox provides a protocol and reagents to quickly and efficiently assemble functional CRISPR-Cas9 T-DNA constructs for monocots and dicots using Golden Gate and Gateway cloning methods. It comes with a full suite of capabilities, including multiplexed gene editing and transcriptional activation or repression of plant endogenous genes. T-DNA based transformation technology is fundamental to modern plant biotechnology, genetics, molecular biology and physiology. As such, a method for the assembly of Cas9 (WT, nickase or dCas9) and gRNA(s) into a T-DNA destination-vector of interest can be used with the CRISPR-Cas systems described herein. This assembly method is based on both Golden Gate assembly and MultiSite Gateway recombination. Three modules are used for this assembly. The first module is a Cas9 entry vector, which contains promoterless Cas9 or its derivative genes flanked by attL1 and attR5 sites. The second module is a gRNA entry vector which contains entry gRNA expression cassettes flanked by attL5 and attL2 sites. The third module includes attR1-attR2-containing destination T-DNA vectors that provide promoters of choice for Cas9 expression. The toolbox of Lowder et al. may be applied to the small Type II-D CRISPR-Cas systems described herein.

Wang et al. (bioRxiv 051342; doi: https://doi.org/10.1101/051342; Epub. May 12, 2016) demonstrate editing of homoeologous copies of four genes affecting important agronomic traits in hexaploid wheat using a multiplexed gene editing construct with several gRNA-tRNA units under the control of a single promoter. The methods of Wang et al., can be applied to the CRISPR-Cas systems described herein.

The CRISPR-Cas systems described herein can be used to modify one or more genes in a tree. The CRISPR-Cas systems described herein can be used for modification of herbaceous systems (see, e.g., Belhaj et al., Plant Methods 9: 39 and Harrison et al., Genes & Development 28: 1859-1872). In some embodiments, the CRISPR Cas systems described herein can be used to target single nucleotide polymorphisms (SNPs) in trees (see, e.g., Zhou et al., New Phytologist, Volume 208, Issue 2, pages 298-301, October 2015). Zhou et al., applied a CRISPR-Cas system in the woody perennial *Populus* using the 4-coumarate:CoA ligase (4CL) gene family as a case study and achieved 100% mutational efficiency for two 4CL genes targeted, with every transformant examined carrying biallelic modifications. The CRISPR-Cas system of Zhou et al., was highly sensitive to single nucleotide polymorphisms (SNPs), as cleavage for a third 4CL gene was abolished due to SNPs in the target sequence. These methods may be applied to the CRISPR-Cas systems described herein. In some embodiments, two 4CL genes, 4CL1 and 4CL2, associated with lignin and flavonoid biosynthesis, respectively can be targeted and modified by the CRISPR-Cas systems described herein. The *Populus tremula*×alba clone 717-1B4 routinely used for transformation is divergent from the genome-sequenced *Populus trichocarpa*. Therefore, in some embodiments, the 4CL1 and 4CL2 gRNAs can be designed from the reference genome are interrogated with in-house 717 RNA-Seq data to ensure the absence of SNPs which could limit Cas efficiency. A third gRNA can be designed for 4CL5, a genome duplicate of 4CL1, is also included. The corresponding 717 sequence can harbor one SNP in each allele near/within the PAM, both of which are expected to abolish targeting by the 4CL5-gRNA. All three gRNA target sites are located within the first exon. For 717 transformation, the gRNA can be expressed from the *Medicago* U6.6 promoter, along with a human codon-optimized Cas under control of the CaMV 35S promoter in a binary vector. Transformation with the Cas-only vector can serve as a control. Randomly selected 4CL1 and 4CL2 lines are subjected to amplicon-sequencing. The data can then be processed and biallelic mutations are confirmed in all cases.

Modified Insects

In some embodiments, the CRISPR-Cas systems described herein can be used to modify one or more polynucleotides in an arthropod such as an insect. In some embodiments, the modification can improve or reduce the insect's resistance to a pesticide or other environmental chemical, improve an insect's resistance to a disease or disease causing organism, and/or can reduce an insect's ability to be a host or vector for a disease causing organism or pathogen. Other beneficial modifications that can be introduced by the CRISPR-Cas systems described herein into an insect will be appreciated in view of this disclosure.

Exemplary insects for modification can include, but are not limited to, any of those in the following orders: Apocrita (includes ants, bees, and wasps), Coleoptera (includes beetles and weevils), Lepidoptera (includes butterflies and moths), Trichoptera (includes caddisflies), Blattodea (includes cockroaches), Orthoptera (includes crickets, grasshoppers, and katydids), Diplura (includes diplurans), Odonata (includes dragonflies and damselflies), Dermaptera (includes earwigs), Siphonaptera (includes fleas), Diptera (includes flies), Mantophasmatodea (includes gladiator bugs), Hemiptera (includes hemipterans), Homoptera (includes momopterans), Grylloblattodea (includes icebugs), Neuroptera (includes lacewings), Phthiraptera (includes lice), Mantodea (includes mantids), Ephemeroptera (includes mayflies), Megaloptera (includes megalopterans), Psocoptera (includes Psocids), Mecoptera (includes scorpionflies), Plecoptera (includes stoneflies), Strepsiptera (includes strepsipterans), Isoptera (includes termites), Thysanoptera (includes thrips), Heteroptera (includes true bugs, e.g. assassin bugs, bat bugs, bedbugs, lace bugs, stink bugs, etc.) Embioptera (includes webspinners), Phasmida (includes walkingsticks), and Apterygota (includes apterygote).

Modified Fungi

In some embodiments, the CRISPR-Cas systems described herein can be used to modify one or more polynucleotides in a fungus. In particular embodiments, the CRISPR-Cas system described herein can be used for genome editing of yeast cells. Methods for transforming yeast cells which can be used to introduce polynucleotides encoding the CRISPR-Cas system components are well known to the artisan and are reviewed by Kawai et al., 2010, Bioeng Bugs. 2010 November-December; 1(6): 395-403). Non-limiting examples include transformation of yeast cells by lithium acetate treatment (which may further include carrier DNA and PEG treatment), bombardment or by electroporation. Other methods of delivering the CRISPR-Cas systems are described elsewhere herein.

As used herein, a "fungal cell" refers to any type of eukaryotic cell within the kingdom of fungi. Phyla within the kingdom of fungi include Ascomycota, Basidiomycota, Blastocladiomycota, Chytridiomycota, Glomeromycota, Microsporidia, and Neocallimastigomycota. Fungal cells may include yeasts, molds, and filamentous fungi. In some embodiments, the fungal cell is a yeast cell.

As used herein, the term "yeast cell" refers to any fungal cell within the phyla Ascomycota and Basidiomycota. Yeast cells may include budding yeast cells, fission yeast cells, and mold cells. Without being limited to these organisms, many types of yeast used in laboratory and industrial settings are part of the phylum Ascomycota. In some embodiments, the yeast cell is an *S. cerevisiae, Kluyveromyces marxianus*, or *Issatchenkia orientalis* cell. Other yeast cells may include without limitation *Candida* spp. (e.g., *Candida albicans*), *Yarrowia* spp. (e.g., *Yarrowia lipolytica*), *Pichia* spp. (e.g., *Pichia pastoris*), *Kluyveromyces* spp. (e.g., *Kluyveromyces lactis* and *Kluyveromyces marxianus*), *Neurospora* spp. (e.g., *Neurospora crassa*), *Fusarium* spp. (e.g., *Fusarium oxysporum*), and *Issatchenkia* spp. (e.g., *Issatchenkia orientalis*, a.k.a. *Pichia kudriavzevii* and *Candida acidothermophilum*). In some embodiments, the fungal cell is a filamentous fungal cell. As used herein, the term "filamentous fungal cell" refers to any type of fungal cell that grows in filaments, i.e., hyphae or mycelia. Examples of filamentous fungal cells may include without limitation *Aspergillus* spp. (e.g., *Aspergillus niger*), *Trichoderma* spp. (e.g., *Trichoderma reesei*), *Rhizopus* spp. (e.g., *Rhizopus oryzae*), and *Mortierella* spp. (e.g., *Mortierella isabellina*).

In some embodiments, the fungal cell modified is an industrial strain. As used herein, "industrial strain" refers to any strain of fungal cell used in or isolated from an industrial process, e.g., production of a product on a commercial or industrial scale. Industrial strain may refer to a fungal species that is typically used in an industrial process, or it may refer to an isolate of a fungal species that may be also used for non-industrial purposes (e.g., laboratory research). Examples of industrial processes may include fermentation (e.g., in production of food or beverage products), distillation, biofuel production, production of a compound, and production of a polypeptide. Examples of industrial strains may include, without limitation, JAY270 and ATCC4124.

In some embodiments, the fungal cell modified is a polyploid cell. As used herein, a "polyploid" cell may refer to any cell whose genome is present in more than one copy. A polyploid cell may refer to a type of cell that is naturally found in a polyploid state, or it may refer to a cell that has been induced to exist in a polyploid state (e.g., through specific regulation, alteration, inactivation, activation, or modification of meiosis, cytokinesis, or DNA replication). A polyploid cell may refer to a cell whose entire genome is polyploid, or it may refer to a cell that is polyploid in a particular genomic locus of interest. Without wishing to be bound to theory, it is thought that the abundance of gRNA may more often be a rate-limiting component in genome engineering of polyploid cells than in haploid cells, and thus the methods using the CRISPR-Cas system described herein may take advantage of using a certain fungal cell type.

In some embodiments, the fungal cell modified is a diploid cell. As used herein, a "diploid" cell may refer to any cell whose genome is present in two copies. A diploid cell may refer to a type of cell that is naturally found in a diploid state, or it may refer to a cell that has been induced to exist in a diploid state (e.g., through specific regulation, alteration, inactivation, activation, or modification of meiosis, cytokinesis, or DNA replication). For example, the S. cerevisiae strain S228C may be maintained in a haploid or diploid state. A diploid cell may refer to a cell whose entire genome is diploid, or it may refer to a cell that is diploid in a particular genomic locus of interest. In some embodiments, the fungal cell is a haploid cell. As used herein, a "haploid" cell may refer to any cell whose genome is present in one copy. A haploid cell may refer to a type of cell that is naturally found in a haploid state, or it may refer to a cell that has been induced to exist in a haploid state (e.g., through specific regulation, alteration, inactivation, activation, or modification of meiosis, cytokinesis, or DNA replication). For example, the S. cerevisiae strain S228C may be maintained in a haploid or diploid state. A haploid cell may refer to a cell whose entire genome is haploid, or it may refer to a cell that is haploid in a particular genomic locus of interest.

Modifying Yeast for Biofuel Production

The CRISPR-Cas systems described herein can be used bioethanol production by recombinant micro-organisms, such as yeast. to generate biofuel or biopolymers from fermentable sugars and optionally to be able to degrade plant-derived lignocellulose derived from agricultural waste as a source of fermentable sugars. In some embodiments, a CRISPR-Cas system, such as a CRISPR-Cas complex, can be used to introduce foreign genes required for biofuel production into micro-organisms and/or to modify endogenous genes why may interfere with the biofuel synthesis. In some embodiments, a method can include introducing into a micro-organism, such as a yeast, one or more nucleotide sequence encoding enzymes involved in the conversion of pyruvate to ethanol or another product of interest, where the one or more nucleotide sequences can be introduced using a CRISPR-Cas system described herein. In some embodiments, the methods ensure the introduction of one or more polynucleotides that encode enzyme(s) which allows the micro-organism to degrade cellulose, such as a cellulase, where the introduction of the one or more polynucleotides is facilitated by a CRISPR-Cas system described herein. In yet further embodiments, the CRISPR-Cas system described herein is used to modify endogenous metabolic pathways which compete with the biofuel production pathway.

In some embodiments, the method can include introducing at least one heterologous nucleic acid or increase expression of at least one endogenous nucleic acid encoding a plant cell wall degrading enzyme, such that said micro-organism is capable of expressing said nucleic acid and of producing and secreting said plant cell wall degrading enzyme;

introducing at least one heterologous nucleic acid or increase expression of at least one endogenous nucleic acid encoding an enzyme that converts pyruvate to acetaldehyde optionally combined with at least one heterologous nucleic acid encoding an enzyme that converts acetaldehyde to ethanol such that said host cell is capable of expressing said nucleic acid; and/or modifying at least one nucleic acid encoding for an enzyme in a metabolic pathway in said host cell, wherein said pathway produces a metabolite other than acetaldehyde from pyruvate or ethanol from acetaldehyde, and wherein said modification results in a reduced production of said metabolite, or to introduce at least one nucleic acid encoding for an inhibitor of said enzyme.

The CRISPR-Cas system described herein can be used to generate modified yeast having improved xylose or cellobiose utilization. Thus, described herein are modified yeast having improved xylose or cellobiose utilization.

In particular embodiments, the CRISPR-Cas system described herein may be applied to select for improved xylose or cellobiose utilizing yeast strains. Error-prone PCR can be used to amplify one (or more) genes involved in the xylose utilization or cellobiose utilization pathways. Examples of genes involved in xylose utilization pathways and cellobiose utilization pathways may include, without limitation, those described in Ha, S. J., et al. (2011) Proc. Natl. Acad. Sci. USA 108(2):504-9 and Galazka, J. M., et al. (2010) Science 330(6000):84-6. Resulting libraries of double-stranded DNA molecules, each comprising a random mutation in such a selected gene could be co-transformed with the components of the CRISPR-Cas system into a yeast strain (for instance S288C) and strains can be selected with enhanced xylose or cellobiose utilization capacity, as described in WO2015138855.

The CRISPR-Cas systems described herein can be used to generate improved yeasts strains for use in isoprenoid biosynthesis.

Tadas Jakočiūnas et al. described the successful application of a multiplex CRISPR/Cas9 system for genome engineering of up to 5 different genomic loci in one transformation step in baker's yeast Saccharomyces cerevisiae (Metabolic Engineering Volume 28, March 2015, Pages 213-222) resulting in strains with high mevalonate production, a key intermediate for the industrially important isoprenoid biosynthesis pathway. In particular embodiments, the small Type II-D CRISPR-Cas systems described herein may be applied in a multiplex genome engineering method as described herein for identifying additional high producing yeast strains for use in isoprenoid synthesis.

The small Type II-D CRISPR-Cas systems described herein can be used to generate lactic acid producing yeasts strains.

In another embodiment, successful application of a multiplex CRISPR-Cas system is encompassed. In analogy with Vratislav Stovicek et al. (Metabolic Engineering Communications, Volume 2, December 2015, Pages 13-22), improved lactic acid-producing strains can be designed and obtained in a single transformation event. In a particular embodiment, the small Type II-D CRISPR-Cas system described herein is used for simultaneously inserting the heterologous lactate dehydrogenase gene and disruption of two endogenous genes PDC1 and PDC5 genes.

Modified Microorganisms

The CRISPR-Cas systems described herein can be expressed in and can be used to generate modified micro-organisms.

In certain embodiments, the modified micro-organisms can be capable of fatty acid production. In particular embodiments, the CRISPR-Cas systems described herein can be used to generate genetically engineered micro-organisms capable of the production of fatty esters, such as fatty acid methyl esters ("FAME") and fatty acid ethyl esters ("FAEE"), In some embodiments, host cells can be engineered to produce fatty esters from a carbon source, such as an alcohol, present in the medium, by expression or overexpression of a gene encoding a thioesterase, a gene encoding an acyl-CoA synthase, and a gene encoding an ester synthase. Accordingly, the methods provided herein are used to modify a micro-organisms so as to overexpress or introduce a thioesterase gene, a gene encoding an acyl-CoA synthase, and a gene encoding an ester synthase. In particular embodiments, the thioesterase gene is selected from tesA, 'tesA, tesB, fatB, fatB2, fatB3, fatA1, or fatA. In particular embodiments, the gene encoding an acyl-CoA synthase is selected from fadDJadK, BH3103, pfl-4354, EAV15023, fadD1, fadD2, RPC_4074, fadDD35, fadDD22, faa39, or an identified gene encoding an enzyme having the same properties. In particular embodiments, the gene encoding an ester synthase is a gene encoding a synthase/acyl-CoA: diacylglycerol acyltransferase from *Simmondsia chinensis, Acinetobacter* sp. ADP, *Alcanivorax borkumensis, Pseudomonas aeruginosa, Fundibacter jadensis, Arabidopsis thaliana*, or *Alcaligenes eutrophus*, or a variant thereof.

In some embodiments, the CRISPR-Cas systems described herein are used to modify a microorganism such that the modified microorganism has decreased expression of at least one of a gene encoding an acyl-CoA dehydrogenase, a gene encoding an outer membrane protein receptor, and a gene encoding a transcriptional regulator of fatty acid biosynthesis. In particular embodiments one or more of these genes is inactivated, such as by introduction of a mutation. In particular embodiments, the gene encoding an acyl-CoA dehydrogenase is fadE. In particular embodiments, the gene encoding a transcriptional regulator of fatty acid biosynthesis encodes a DNA transcription repressor, for example, fabR.

In some embodiments, the CRISPR-Cas systems described herein are used to modify a microorganism such that the modified microorganism has reduced expression of at least one of a gene encoding a pyruvate formate lyase, a gene encoding a lactate dehydrogenase, or both. In particular embodiments, the gene encoding a pyruvate formate lyase is pflB. In particular embodiments, the gene encoding a lactate dehydrogenase is ldhA. In particular embodiments, one or more of these genes is inactivated, such as by introduction of a mutation therein.

In particular embodiments, the micro-organism modified is selected from the genus *Escherichia, Bacillus, Lactobacillus, Rhodococcus, Synechococcus, Synechocystis, Pseudomonas, Aspergillus, Trichoderma, Neurospora, Fusarium, Humicola, Rhizomucor, Kluyveromyces, Pichia, Mucor, Myceliophthora, Penicillium, Phanerochaete, Pleurotus, Trametes, Chrysosporium, Saccharomyces, Stenotrophomonas, Schizosaccharomyces, Yarrowia*, or *Streptomyces*.

The CRISPR-Cas system described herein can be used to generate modified micro-organisms capable of organic acid production. Thus, described herein are modified micro-organisms capable of producing organic acids.

The CRISPR-Cas systems provided herein are further used to engineer micro-organisms capable of organic acid production, more particularly from pentose or hexose sugars. In particular embodiments, the methods comprise introducing into a micro-organism an exogenous LDH gene. In particular embodiments, the organic acid production in said micro-organisms is additionally or alternatively increased by using the CRISPR-Cas systems described herein to inactivate endogenous genes encoding proteins involved in an endogenous metabolic pathway which produces a metabolite other than the organic acid of interest and/or wherein the endogenous metabolic pathway consumes the organic acid. In particular embodiments, the modification ensures that the production of the metabolite other than the organic acid of interest is reduced. In some embodiments, the CRISPR-Cas systems described herein can introduce at least one engineered gene deletion and/or inactivation of an endogenous pathway in which the organic acid is consumed or a gene encoding a product involved in an endogenous pathway which produces a metabolite other than the organic acid of interest. In particular embodiments, the CRISPR-Cas systems described herein introduce at least one engineered gene deletion or inactivation is in one or more gene encoding an enzyme selected from the group consisting of pyruvate decarboxylase (pdc), fumarate reductase, alcohol dehydrogenase (adh), acetaldehyde dehydrogenase, phosphoenolpyruvate carboxylase (ppc), D-lactate dehydrogenase (d-ldh), L-lactate dehydrogenase (l-ldh), lactate 2-monooxygenase. In further embodiments the at least one engineered gene deletion and/or inactivation is in an endogenous gene encoding pyruvate decarboxylase (pdc).

In further embodiments, the CRISPR-Cas system is used to modify a micro-organism to produce lactic acid by introducing at least one engineered gene deletion and/or inactivation, which can be an endogenous gene encoding lactate dehydrogenase. In some embodiments, the microorganism comprises at least one engineered gene deletion or inactivation of an endogenous gene encoding a cytochrome-dependent lactate dehydrogenase, such as a cytochrome B2-dependent L-lactate dehydrogenase.

The following additional references can be adapted and applied though the CRISPR-Cas systems described herein to produce various modified micro-organisms: PCT Publications WO2016/099887; WO2016/025131; WO2016/073433; WO2017/066175; WO2017/100158; WO 2017/105991; WO2017/106414; WO2016/100272; WO2016/100571; WO 2016/100568; WO 2016/100562; and WO 2017/019867.

Kits

Also described herein are kits that contain one or more of the one or more of the polypeptides, polynucleotides, vectors, cells, or other components described herein and combinations thereof and pharmaceutical formulations described herein. In certain embodiments, one or more of the polypeptides, polynucleotides, vectors, cells, and combinations thereof described herein can be presented as a combination kit. As used herein, the terms "combination kit" or "kit of parts" refers to the compounds, or formulations and additional components that are used to package, screen, test, sell, market, deliver, and/or administer the combination of elements or a single element, such as the active ingredient, contained therein. Such additional components include but are not limited to, packaging, syringes, blister packages, bottles, and the like. The combination kit can contain one or more of the components (e.g., one or more of the one or more of the polypeptides, polynucleotides, vectors, cells, and combinations thereof) or formulation thereof can be provided in a single formulation (e.g., a liquid, lyophilized powder, etc.), or in separate formulations. The separate components or formulations can be contained in a single package or in separate packages within the kit. The kit can also include instructions in a tangible medium of expression that can contain information and/or directions regarding the content of the components and/or formulations contained therein, safety information regarding the content of the components(s) and/or formulation(s) contained therein, information regarding the amounts, dosages, indications for use, screening methods, component design recommendations and/or information, recommended treatment regimen(s) for the components(s) and/or formulations contained therein. As used herein, "tangible medium of expression" refers to a medium that is physically tangible or accessible and is not a mere abstract thought or an unrecorded spoken word. "Tangible medium of expression" includes, but is not limited to, words on a cellulosic or plastic material, or data stored in a suitable computer readable memory form. The data can be stored on a unit device, such as a flash memory drive or CD-ROM or on a server that can be accessed by a user via, e.g., a web interface. In some embodiments, the kit includes instructions in one or more languages, for example in more than one language. The instructions may be specific to the applications and methods described herein.

In some embodiments, the kit comprises a vector system as taught herein or one or more of the components of the system or complex as taught herein, such as crRNAs and/or Cas protein or Cas protein encoding mRNA, and instructions for using the kit. Elements may be provided individually or in combinations, and may be provided in any suitable container, such as a vial, a bottle, or a tube. In some embodiments, a kit comprises one or more reagents for use in a process utilizing one or more of the elements described herein. Reagents may be provided in any suitable container. For example, a kit may provide one or more reaction or storage buffers. Reagents may be provided in a form that is usable in a particular assay, or in a form that requires addition of one or more other components before use (e.g., in concentrate or lyophilized form). A buffer can be any buffer, including but not limited to a sodium carbonate buffer, a sodium bicarbonate buffer, a borate buffer, a Tris buffer, a MOPS buffer, a HEPES buffer, and combinations thereof. In some embodiments, the buffer is alkaline. In some embodiments, the buffer has a pH from about 7 to about 10. In some embodiments, the kit comprises one or more oligonucleotides corresponding to a guide sequence for insertion into a vector so as to operably link the guide or crRNA sequence and a regulatory element. In some embodiments, the kit comprises a homologous recombination template polynucleotide. In some embodiments, the kit comprises one or more of the vectors and/or one or more of the polynucleotides described herein. The kit may advantageously allow to provide all elements of the systems of the invention.

Methods of Using the CRISPR-Cas Systems

The CRISPR-Cas systems and/or components thereof (e.g., a small Type II-D Cas protein or variant thereof) can be used to modify a polynucleotide in vitro, in vivo, in situ, and/or ex vivo. Such polynucleotide modifications and thus the methods of generating such modifications have various applications in viral, microorganism, plants, animals, and humans. Non-limiting exemplary methods and applications of the CRISPR-Cas systems of the present disclosure are further described in detail below and elsewhere herein. In general, the CRIRSPR-Cas system that includes one or more a small Type II-D Cas proteins or variants thereof can be guided to a target polynucleotide by one or more guide strand. As previously described, a small Type II-D Cas protein or variant thereof can directly modify a target polynucleotide (DNA or RNA) at or within proximity to the one or more positions dictated by the target sequence of the guide molecule(s) within the CIRSRP-Cas system. Such modifications have various uses and applications as are described by the non-limiting examples herein and will be appreciated in view of the description herein. In some embodiments, the CRISPR-Cas system or complex of the present invention, when introduced into a cell, creates a break (e.g., a single or a double strand break) or nicks in the genome sequence. For example, the method can be used to cleave a disease gene in a cell. The break or nick created by the CRISPR complex can be repaired by an endogenous repair processes such as the error prone non-homologous end joining (NHEJ) pathway or the high fidelity homology-directed repair (HDR). These and/or other methods of repair such as those employed when a technique such as those that facilitate polynucleotide repair during prime editing (see e.g., Schene et al. 2020. Nat. Commun. 11:5352) can be induced or activated by one or more activities of the CRISPR-Cas system or complex of the present invention. During these repair processes, an exogenous polynucleotide template can be introduced into or be used to modify the genome sequence. In some methods, the HDR process is used modify genome sequence. As described elsewhere herein, in some embodiments, the CRISPR-Cas system and/or one or more components thereof is configured to promote one or more DNA repair pathways.

In some embodiments, the upstream and downstream sequences in the exogenous polynucleotide template or donor sequence are selected to promote recombination between the chromosomal sequence of interest and the donor polynucleotide. The upstream sequence is a nucleic acid sequence that shares sequence similarity with the genome sequence upstream of the targeted site for integration. Similarly, the downstream sequence is a nucleic acid sequence that shares sequence similarity with the chromosomal sequence downstream of the targeted site of integration. The upstream and downstream sequences in the exogenous polynucleotide template can have 75%, 80%, 85%, 90%, 95%, or 100% sequence identity with the targeted genome sequence. Preferably, the upstream and downstream sequences in the exogenous polynucleotide template have about 95%, 96%, 97%, 98%, 99%, or 100% sequence identity with the targeted genome sequence. In some methods, the upstream and downstream sequences in the exogenous polynucleotide template have about 99% or 100% sequence identity with the targeted genome sequence. An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000 bp.

The double strand break or single strand break in one of the strands advantageously should be sufficiently close to target position such that correction occurs. In an embodiment, the distance is not more than 50, 100, 200, 300, 350 or 400 nucleotides. While not wishing to be bound by theory, it is believed that the break should be sufficiently close to target position such that the break is within the region that is subject to exonuclease-mediated removal during end resection. If the distance between the target position and a break is too great, the mutation may not be included in the end resection and, therefore, may not be corrected, as the template nucleic acid sequence may only be used to correct sequence within the end resection region.

In an embodiment, in which a guide RNA and a Cas or an ortholog or homolog thereof, preferably a Cas nuclease induce a double strand break for the purpose of inducing HDR-mediated correction, the cleavage site is between 0-200 bp (e.g., 0 to 175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 1 25, 75 to 100 bp) away from the target position. In an embodiment, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target position. In a further embodiment, two or more guide RNAs complexing with Cas or an ortholog or homolog thereof may be used to induce multiplexed breaks for purpose of inducing DNA repair.

In some embodiments, the double strand break or single strand break in one of the strands advantageously is sufficiently close to a target position such that correction occurs. In an embodiment, this distance is not more than 50, 100, 200, 300, 350 or 400 nucleotides. While not wishing to be bound by theory, it is believed that the break should be sufficiently close to target position such that the break is within the region that is subject to exonuclease-mediated removal during end resection. If the distance between the target position and a break is too great, the mutation may not be included in the end resection and, therefore, may not be corrected, as the template nucleic acid sequence may only be used to correct sequence within the end resection region.

In an embodiment, in which a guide RNA and a Cas or an ortholog or homolog thereof, preferably a Cas nuclease induce a double strand break for the purpose of inducing HDR-mediated correction, the cleavage site is between 0-200 bp (e.g., 0 to 175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 1 25, 75 to 100 bp) away from the target position. In an embodiment, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target position. In a further embodiment, two or more guide RNAs complexing with Cas or an ortholog or homolog thereof, may be used to induce multiplexed breaks for purpose of inducing DNA repair.

In some embodiments, the homology arm extends at least as far as the region in which end resection may occur, e.g., in order to allow the resected single stranded overhang to find a complementary region within the donor template. The overall length could be limited by parameters such as plasmid size or viral packaging limits. In an embodiment, a homology arm may not extend into repeated elements. Exemplary homology arm lengths include a least 50, 100, 250, 500, 750 or 1000 nucleotides.

Target position, as used herein, refers to a site on a target nucleic acid or target gene (e.g., the chromosome) that is modified by a Cas or an ortholog or homolog thereof, preferably Cas molecule-dependent process. For example, the target position can be a modified small Type II-D Cas molecule cleavage of the target nucleic acid and template nucleic acid directed modification, e.g., correction, of the target position. In an embodiment, a target position can be a site between two nucleotides, e.g., adjacent nucleotides, on the target nucleic acid into which one or more nucleotides is added. The target position may comprise one or more nucleotides that are altered, e.g., corrected, by a template nucleic acid. In an embodiment, the target position is within a target sequence (e.g., the sequence to which the guide RNA binds). In an embodiment, a target position is upstream or downstream of a target sequence (e.g., the sequence to which the guide RNA binds).

In an embodiment, the target nucleic acid is modified to have some or all of the sequence of the template and/or donor nucleic acid, typically at or near cleavage site(s). In an embodiment, the template and/or donor nucleic acid is single stranded. In an alternate embodiment, the template and/or donor nucleic acid is double stranded. In an embodiment, the template and/or donor nucleic acid is DNA, e.g., double stranded DNA. In an alternate embodiment, the template or donor nucleic acid is single stranded DNA.

In an embodiment, the template or donor nucleic acid alters the structure of the target position by participating in homologous recombination. In an embodiment, the template or donor nucleic acid alters the sequence of the target position. In an embodiment, the template or donor nucleic acid results in the incorporation of a modified, or non-naturally occurring base into the target nucleic acid.

The template or donor sequence may undergo a breakage mediated or catalyzed recombination with the target sequence. In an embodiment, the template or donor nucleic acid may include sequence that corresponds to a site on the target sequence that is cleaved by a Cas mediated cleavage event. In an embodiment, the template or donor nucleic acid may include sequence that corresponds to both, a first site on the target sequence that is cleaved in a first Cas mediated event, and a second site on the target sequence that is cleaved in a second Cas mediated event.

In some embodiments, the CRISRP-Cas systems and/or complexes thereof can modify a cell state, type, or status by modifying one or more polynucleotides in a cell. In certain embodiments CRISPR-Cas in a complex with crRNA is activated upon binding to target RNA and subsequently cleaves any nearby ssDNA targets (i.e. "collateral" or "bystander" effects). CRISPR-Cas, once primed by the cognate target, can cleave other (non-complementary) DNA molecules. Such promiscuous RNA cleavage could potentially cause cellular toxicity, or otherwise affect cellular physiology or cell status. Such collateral activity can also be harnessed in assays, which are described in greater detail elsewhere herein.

Accordingly, in certain embodiments, the non-naturally occurring or engineered composition, vector system, or delivery systems as described herein are used for or are for use in induction of cell dormancy. In certain embodiments, the non-naturally occurring or engineered composition, vector system, or delivery systems as described herein are used for or are for use in induction of cell cycle arrest. In certain embodiments, the non-naturally occurring or engineered composition, vector system, or delivery systems as described herein are used for or are for use in reduction of cell growth and/or cell proliferation, In certain embodiments, the non-naturally occurring or engineered composition, vector system, or delivery systems as described herein are used for or are for use in induction of cell anergy. In certain embodiments, the non-naturally occurring or engineered composition, vector system, or delivery systems as described herein are used for or are for use in induction of cell apoptosis. In certain embodiments, the non-naturally occurring or engineered composition, vector system, or delivery systems as described herein are used for or are for use in induction of cell necrosis. In certain embodiments, the non-naturally occurring or engineered composition, vector system, or delivery systems as described herein are used for or are for use in induction of cell death. In certain embodiments, the non-naturally occurring or engineered composition, vector system, or delivery systems as described herein are used for or are for use in induction of programmed cell death.

CRISPR-Cas System Therapeutic Uses and Methods of Treatment

Provided herein are methods of diagnosing, prognosing, treating, and/or preventing a disease, state, or condition in or of a subject. Generally, the methods of diagnosing, prognosing, treating, and/or preventing a disease, state, or condition in or of a subject can include modifying a polynucleotide in a subject or cell thereof using a CRISPR-Cas system or component thereof described herein and/or include detecting a diseased or healthy polynucleotide in a subject or cell thereof using a CRISPR-Cas system or component thereof described herein. In some embodiments, the method of treatment or prevention can include using a CRISPR-Cas system or component thereof to modify a polynucleotide of an infectious organism (e.g., bacterial or virus) within a subject or cell thereof. In some embodiments, the method of treatment or prevention can include using a CRISPR-Cas system or component thereof to modify a polynucleotide of an infectious organism or symbiotic organism within a subject. The CRISPR-Cas systems and components thereof can be used to develop models of diseases, states, or conditions. The CRISPR-Cas systems and components thereof can be used to detect a disease state or correction thereof, such as by a method of treatment or prevention described herein. The CRISPR-Cas systems and components thereof can be used to screen and select cells that can be used, for example, as treatments or preventions described herein. The CRISPR-Cas systems and components thereof can be used to develop biologically active agents that can be used to modify one or more biologic functions or activities in a subject or a cell thereof.

In general, the method can include delivering a CRISPR-Cas System and/or component thereof to a subject or cell thereof, or to an infectious or symbiotic organism by a suitable delivery technique and/or composition. Once administered the components can operate as described elsewhere herein to elicit a nucleic acid modification event. In some embodiments, the nucleic acid modification event can occur at the genomic, epigenomic, and/or transcriptomic level. DNA and/or RNA cleavage, gene activation, and/or gene deactivation can occur. Additional features, uses, and advantages are described in greater detail below. On the basis of this concept, several variations are appropriate to elicit a genomic locus event, including DNA cleavage, gene activation, or gene deactivation. Using the provided compositions and components thereof, the person skilled in the art can advantageously and specifically target single or multiple loci with the same or different functional domains to elicit one or more genomic locus events. In addition to treating and/or preventing a disease in a subject, the compositions may be applied in a wide variety of methods for screening in libraries in cells and functional modeling in vivo (e.g. gene activation of lincRNA and identification of function; gain-of-function modeling; loss-of-function modeling; the use the compositions of the invention to establish cell lines and transgenic animals for optimization and screening purposes).

The CRISPR-Cas systems and components thereof described elsewhere herein can be used to treat and/or prevent a disease, such as a genetic and/or epigenetic disease, in a subject. The CRISPR-Cas systems and components thereof described elsewhere herein can be used to treat and/or prevent genetic infectious diseases in a subject, such as bacterial infections, viral infections, fungal infections, parasite infections, and combinations thereof. The CRISPR-Cas systems and components thereof described elsewhere herein can be used to modify the composition or profile of a microbiome in a subject, which can in turn modify the health status of the subject. The CRISPR-Cas systems described herein can be used to modify cells ex vivo, which can then be administered to the subject whereby the modified cells can treat or prevent a disease or symptom thereof. This is also referred to in some contexts as adoptive therapy. The CRISPR-Cas systems described herein can be used to treat mitochondrial diseases, where the mitochondrial disease etiology involves a mutation in the mitochondrial DNA.

Also provided is a method of treating a subject, e.g., a subject in need thereof, comprising inducing gene editing by transforming the subject with the polynucleotide encoding one or more components of the CRISPR-Cas system or complex or any of polynucleotides or vectors described herein and administering them to the subject. A suitable repair template may also be provided, for example delivered, by a vector comprising said repair template. Also provided is a method of treating a subject, e.g., a subject in need thereof, comprising inducing transcriptional activation or repression of multiple target gene loci by transforming the subject with the polynucleotides or vectors described herein, wherein said polynucleotide or vector encodes or comprises one or more components of CRISPR-Cas system, complex or component thereof comprising multiple Cas effectors. Where any treatment is occurring ex vivo, for example in a cell culture, then it will be appreciated that the term 'subject' may be replaced by the phrase "cell or cell culture."

Also provided is a method of treating a subject, e.g., a subject in need thereof, comprising inducing gene editing by transforming the subject with the Cas effector(s), advantageously encoding and expressing in vivo the remaining portions of the CRISPR-Cas system (e.g., RNA, guides). A suitable repair template may also be provided, for example delivered by a vector comprising said repair template. Also provided is a method of treating a subject, e.g., a subject in need thereof, comprising inducing transcriptional activation or repression by transforming the subject with the Cas effector(s) advantageously encoding and expressing in vivo the remaining portions of the CRISPR-Cas system (e.g., RNA, guides); advantageously in some embodiments the CRISPR enzyme is a catalytically inactive Cas effector and includes one or more associated functional domains. Where any treatment is occurring ex vivo, for example in a cell culture, then it will be appreciated that the term 'subject' may be replaced by the phrase "cell or cell culture."

One or more components of the nucleic acid targeting system described herein (e.g., a CRISPR-Cas system) can be included in a composition, such as a pharmaceutical composition, and administered to a host individually or collectively. Alternatively, these components may be provided in a single composition for administration to a host. Administration to a host may be performed via viral vectors known to the skilled person or described herein for delivery to a host (e.g., lentiviral vector, adenoviral vector, AAV vector). As explained herein, use of different selection markers (e.g., for lentiviral gRNA selection) and concentration of gRNA (e.g. dependent on whether multiple gRNAs are used) may be advantageous for eliciting an improved effect.

Thus, also described herein are methods of inducing one or more polynucleotide modifications in a eukaryotic or prokaryotic cell or component thereof (e.g., a mitochondria) of a subject, infectious organism, and/or organism of the microbiome of the subject. The modification can include the introduction, deletion, or substitution of one or more nucleotides at a target sequence of a polynucleotide of one or more cell(s). The modification can occur in vitro, ex vivo, in situ, or in vivo.

In some embodiments, the method of treating or inhibiting a condition or a disease caused by one or more mutations in a genomic locus in a eukaryotic organism or a non-human organism can include manipulation of a target sequence within a coding, non-coding or regulatory element of said genomic locus in a target sequence in a subject or a non-human subject in need thereof comprising modifying the subject or a non-human subject by manipulation of the target sequence and wherein the condition or disease is susceptible to treatment or inhibition by manipulation of the target sequence including providing treatment comprising delivering a composition comprising the particle delivery system or the delivery system or the virus particle of any one of the above embodiment or the cell of any one of the above embodiment.

Also provided herein is the use of the particle delivery system or the delivery system or the virus particle of any one of the above embodiment or the cell of any one of the above embodiment in ex vivo or in vivo gene or genome editing; or for use in in vitro, ex vivo, or in vivo gene therapy. Also provided herein are particle delivery systems, non-viral delivery systems, and/or the virus particle of any one of the above embodiments or the cell of any one of the above embodiments used in the manufacture of a medicament for in vitro, ex vivo or in vivo gene or genome editing or for use in in vitro, ex vivo or in vivo gene therapy or for use in a method of modifying an organism or a non-human organism by manipulation of a target sequence in a genomic locus associated with a disease or in a method of treating or inhibiting a condition or disease caused by one or more mutations in a genomic locus in a eukaryotic organism or a non-human organism.

In some embodiments, polynucleotide modification can include the introduction, deletion, or substitution of 1-75 nucleotides at each target sequence of said polynucleotide of said cell(s). The modification can include the introduction, deletion, or substitution of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, to/or 100 nucleotides at each target sequence. The modification can include the introduction, deletion, or substitution of 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, to/or 100 nucleotides at each target sequence of said cell(s). The modification can include the introduction, deletion, or substitution of 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, to/or 100 nucleotides at each target sequence of said cell(s). The modification can include the introduction, deletion, or substitution of 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, to/or 100 nucleotides at each target sequence of said cell(s). The modification can include the introduction, deletion, or substitution of 40, 45, 50, 75, 100, 200, 300, 400 to/or 500 nucleotides at each target sequence of said cell(s). The modification can include the introduction, deletion, or substitution of about 100, 200, 300, 400, 500, 600, 700, 800, 900, 1000, 1100, 1200, 1300, 1400, 1500, 1600, 1700, 1800, 1900, 2000, 2100, 2200, 2300, 2400, 2500, 2600, 2700, 2800, 2900, 3000, 3100, 3200, 3300, 3400, 3500, 3600, 3700, 3800, 3900, 4000, 4100, 4200, 4300, 4400, 4500, 4600, 4700, 4800, 4900, 5000, 5100, 5200, 5300, 5400, 5500, 5600, 5700, 5800, 5900, 6000, 6100, 6200, 6300, 6400, 6500, 6600, 6700, 6800, 6900, 7000, 7100, 7200, 7300, 7400, 7500, 7600, 7700, 7800, 7900, 8000, 8100, 8200, 8300, 8400, 8500, 8600, 8700, 8800, 8900, 9000, 9100, 9200, 9300, 9400, 9500, 9600, 9700, 9800, 9900 to/or about 10000 nucleotides at each target sequence of said cell(s).

In some embodiments, the modifications can include the introduction, deletion, or substitution of nucleotides at each target sequence of said cell(s) via nucleic acid components (e.g., guide(s) RNA(s) or sgRNA(s)), such as those mediated by a CRISPR-Cas system or a component thereof described elsewhere herein. In some embodiments, the modifications can include the introduction, deletion, or substitution of nucleotides at a target or random sequence of said cell(s) via a non CRISPR-Cas system or technique.

The target genes and/or sequences of polynucleotides to be modified to treat or prevent disease are described in greater detail below.

As is also discussed elsewhere herein, the CRISPR-Cas system can include a template or donor polynucleotide (also referred to herein as template nucleic acids, template sequence, donor sequence, donor nucleic acid(s) and the like). In an embodiment, the template or donor nucleic acid alters the structure of the target position by participating in homologous recombination. In an embodiment, the template or donor nucleic acid alters the sequence of the target position. In an embodiment, the template or donor nucleic acid results in the incorporation of a modified, or non-naturally occurring base or bases into the target nucleic acid. In an embodiment, the template or donor nucleic acid results in the incorporation of a modified, or non-naturally occurring (relative to the original target polynucleotide) gene or fragment thereof into the target nucleic acid.

The template or donor sequence may undergo a breakage mediated or catalyzed recombination with the target sequence. In an embodiment, the template nucleic acid can include sequence that corresponds to a site on the target sequence that is cleaved, nicked, or otherwise modified by one or more Cas effector mediated cleavage event(s). In an embodiment, the template nucleic acid can include sequence that corresponds to both, a first site on the target sequence that is cleaved, nicked, or otherwise modified in a first Cas effector mediated event, and a second site on the target sequence that is cleaved in a second Cas effector mediated event.

In certain embodiments, the template or donor nucleic acid can include a sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation. In certain embodiments, the template or donor nucleic acid can include a sequence which results in an alteration in a non-coding sequence, e.g., an alteration in an exon or in a 5' or 3' non-translated or non-transcribed region. Such alterations include an alteration in a control element, e.g., a promoter, enhancer, and an alteration in a cis-acting or trans-acting control element.

A template or donor nucleic acid having homology with a target position in a target gene may be used to alter the structure of a target sequence. The template or donor sequence may be used to alter an unwanted structure, e.g., an unwanted or mutant nucleotide. The template or donor nucleic acid may include sequence which, when integrated, results in: decreasing the activity of a positive control element; increasing the activity of a positive control element; decreasing the activity of a negative control element; increasing the activity of a negative control element; decreasing the expression of a gene; increasing the expression of a gene; increasing resistance to a disorder or disease; increasing resistance to viral entry; correcting a mutation or altering an unwanted amino acid residue conferring, increasing, abolishing or decreasing a biological property of a gene product, e.g., increasing the enzymatic activity of an enzyme, or increasing the ability of a gene product to interact with another molecule.

The template or donor nucleic acid may include sequence which results in: a change in sequence of 1, 2, 3, 4, 5, 6, 7, 8, 9, 10, 11, 12 or more nucleotides of the target sequence. In an embodiment, the template or donor nucleic acid may be 20+/−10, 30+/−10, 40+/−10, 50+/−10, 60+/−10, 70+/−10, 80+/−10, 90+/−10, 100+/−10, 110+/−10, 120+/−10, 130+/−10, 140+/−10, 150+/−10, 160+/−10, 170+/−10, 180+/−10, 190+/−10, 200+/−10, 210+/−10, of 220+/−10 nucleotides in length. In an embodiment, the template or donor nucleic acid may be 30+/−20, 40+/−20, 50+/−20, 60+/−20, 70+/−20, 80+/−20, 90+/−20, 100+/−20, 110+/−20, 120+/−20, 130+/−20, 140+/−20, 150+/−20, 160+/−20, 170+/−20, 180+/−20, 190+/−20, 200+/−20, 210+/−20, of 220+/−20 nucleotides in length. In an embodiment, the template or donor nucleic acid is 10 to 1,000, 20 to 900, 30 to 800, 40 to 700, 50 to 600, 50 to 500, 50 to 400, 50 to 300, 50 to 200, or 50 to 100 nucleotides in length.

In some embodiments, a template or donor nucleic acid comprises the following components: [5' homology arm]-[replacement sequence]-[3' homology arm]. The homology arms provide for recombination into the chromosome, thus replacing the undesired element, e.g., a mutation or signature, with the replacement sequence. In an embodiment, the homology arms flank the most distal cleavage sites. In an embodiment, the 3' end of the 5' homology arm is the position next to the 5' end of the replacement sequence. In an embodiment, the 5' homology arm can extend at least 10, 20, 30, 40, 50, 100, 200, 300, 400, 500, 600, 700, 800, 900, 1000, 1500, or 2000 nucleotides 5' from the 5' end of the replacement sequence. In an embodiment, the 5' end of the 3' homology arm is the position next to the 3' end of the replacement sequence. In an embodiment, the 3' homology arm can extend at least 10, 20, 30, 40, 50, 100, 200, 300, 400, 500, 600, 700, 800, 900, 1000, 1500, or 2000 nucleotides 3' from the 3' end of the replacement sequence.

In certain embodiments, one or both homology arms may be shortened to avoid including certain sequence repeat elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In certain embodiments, a template or donor nucleic acid for correcting a mutation may designed for use as a single-stranded oligonucleotide. When using a single-stranded oligonucleotide, 5' and 3' homology arms may range up to about 200 base pairs (bp) in length, e.g., at least 25, 50, 75, 100, 125, 150, 175, or 200 bp in length.

In some embodiments, the CRISPR-Cas system or component thereof can promote a specific double stranded break (DSB) repair pathway such as Non-Homologous End-Joining (NHEJ) or homology directed repair (HDR). Various approaches such as template or donor configuration, target sequence selection, guide sequence configuration, and/or the incorporation of one or more DSB repair pathway modulators in the CRISPR-Cas system can be used to promote and/or minimize a specific DSB repair pathway. Such mechanisms and approaches are described in greater detail below and elsewhere herein.

In some embodiments, the CRISRP-Cas system promotes Non-Homologous End-Joining (NHEJ). In some embodiments, modification of a polynucleotide by a CRISPR-Cas system or a component thereof, such as a diseased polynucleotide, can include NHEJ and/or HDR. In some embodiments, promotion of this NHEJ or HDR pathway by the CRISPR-Cas system or a component thereof can be used to target gene or polynucleotide specific knock-outs and/or knock-ins. In some embodiments, promotion of the NHEJ repair pathway by the CRISPR-Cas system or a component thereof can be used to generate NHEJ-mediated indels. Nuclease-induced NHEJ can also be used to remove (e.g., delete) sequence in a gene of interest. Generally, NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, at one or both strands, prior to rejoining of the ends. This results in the presence of insertion and/or deletion (indel) mutations in the DNA sequence at the site of the NHEJ repair. The indel can range in size from 1-50 or more base pairs. In some embodiments the indel can be 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, or 500 base pairs or more. If a double-strand break is targeted near to a short target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. Both of these approaches can be used to delete specific DNA sequences.

In some embodiments, CRISPR-Cas system mediated NHEJ can be used in the method to delete small sequence motifs. In some embodiments, CRISPR-Cas system mediated NHEJ can be used in the method to generate NHEJ-mediate indels that can be targeted to the gene, e.g., a coding region, e.g., an early coding region of a gene of interest can be used to knockout (i.e., eliminate expression of) a gene of interest. For example, early coding region of a gene of interest includes sequence immediately following a transcription start site, within a first exon of the coding sequence, or within 500 bp of the transcription start site (e.g., less than 500, 450, 400, 350, 300, 250, 200, 150, 100 or 50 bp). In an embodiment, in which a guide RNA and Cas effector generate a double strand break for the purpose of inducing NHEJ-mediated indels, a guide RNA may be configured to position one double-strand break in close proximity to a nucleotide of the target position. In an embodiment, the cleavage site may be between 0-500 bp away from the target position (e.g., less than 500, 400, 300, 200, 100, 50, 40, 30, 25, 20, 15, 10, 9, 8, 7, 6, 5, 4, 3, 2 or 1 bp from the target position). In an embodiment, in which two guide RNAs complexing with one or more Cas nickases induce two single strand breaks for the purpose of inducing NHEJ-mediated indels, two guide RNAs may be configured to position two single-strand breaks to provide for NHEJ repair a nucleotide of the target position.

In some embodiments, the NHEJ repair pathway is minimized or reduced and/or the HDR pathway is promoted. In some embodiments, the CRISPR-Cas system includes one or more NHEJ inhibitors and/or one or more HDR activators. In some embodiments, the donor polynucleotide is configured to promote HDR, the target sequence is selected to promote HDR, the guide molecule is configured to promote HDR, or a combination thereof. In some embodiments, the CRISPR-Cas system includes one or more NHEJ inhibitors and/or one or more HDR activators.

For minimization of toxicity and off-target effect, the concentration of Cas mRNA and guide RNA delivered can be optimized and controlled. Optimal concentrations of Cas mRNA and guide RNA can be determined by testing different concentrations in a cellular or non-human eukaryote animal model and using deep sequencing the analyze the extent of modification at potential off-target genomic loci. Alternatively, to minimize the level of toxicity and off-target effect, Cas nickase mRNA (for example small Type II-D Cas with the D10A mutation) can be delivered with a pair of guide RNAs targeting a site of interest. Guide sequences and strategies to minimize toxicity and off-target effects can be as in International Patent Publication No. WO 2014/093622 (PCT/US2013/074667); or, via mutation. Others are as described elsewhere herein.

Typically, in the context of an endogenous CRISPR system, formation of a CRISPR complex (comprising a guide sequence hybridized to a target sequence and complexed with one or more Cas proteins) results in cleavage, nicking, and/or another modification of one or both strands in or near (e.g., within 1, 2, 3, 4, 5, 6, 7, 8, 9, 10, 20, 50, or more base pairs from) the target sequence. In some embodiments, the tracr sequence, which may comprise or consist of all or a portion of a wild-type tracr sequence (e.g., about or more than about 20, 26, 32, 45, 48, 54, 63, 67, 85, or more nucleotides of a wild-type tracr sequence), can also form part of a CRISPR complex, such as by hybridization along at least a portion of the tracr sequence to all or a portion of a tracr mate sequence that is operably linked to the guide sequence.

In some embodiments, a method of modifying a target polynucleotide in a cell to treat or prevent a disease can include allowing a CRISPR-Cas system or component thereof to bind to the target polynucleotide, e.g., to effect cleavage, nicking, or other modification as the CRISPR-Cas system is capable of said target polynucleotide, thereby modifying the target polynucleotide, wherein the CRISPR-Cas system or component thereof, complex with a guide sequence, and hybridize said guide sequence to a target sequence within the target polynucleotide, wherein said guide sequence is optionally linked to a tracr mate sequence, which in turn can hybridize to a tracr sequence. In some of these embodiments, the CRISPR-Cas system or component thereof can be or include a CRISPR-Cas effector complexed with a guide sequence. In some embodiments, modification can include cleaving or nicking one or two strands at the location of the target sequence by one or more components of the CRISPR-Cas system or component thereof.

The cleavage, nicking, or other modification capable of being performed by the CRISPR-Cas system can modify transcription of a target polynucleotide. In some embodiments, modification of transcription can include decreasing transcription of a target polynucleotide. In some embodiments, modification can include increasing transcription of a target polynucleotide. In some embodiments, the method includes repairing said cleaved target polynucleotide by homologous recombination with an exogenous template polynucleotide, wherein said repair results in a modification such as, but not limited to, an insertion, deletion, or substitution of one or more nucleotides of said target polynucleotide. In some embodiments, said modification results in one or more amino acid changes in a protein expressed from a gene comprising the target sequence. In some embodiments, the modification imparted by the CRISPR-Cas system or component thereof provides a transcript and/or protein that can correct a disease or a symptom thereof, including but not limited to, any of those described in greater detail elsewhere herein.

In some embodiments, the method of treating or preventing a disease can include delivering one or more vectors or vector systems to a cell, such as a eukaryotic or prokaryotic cell, wherein one or more vectors or vector systems include the CRISPR-Cas system or component thereof. In some embodiments, the vector(s) or vector system(s) can be a viral vector or vector system, such as an AAV or lentiviral vector system, which are described in greater detail elsewhere herein. In some embodiments, the method of treating or preventing a disease can include delivering one or more viral particles, such as an AAV or lentiviral particle, containing the CRISPR-Cas system or component thereof. In some embodiments, the viral particle has a tissue specific tropism. In some embodiments, the viral particle has a liver, muscle, eye, heart, pancreas, kidney, neuron, epithelial cell, endothelial cell, astrocyte, glial cell, immune cell, or red blood cell specific tropism.

It will be understood that the CRISPR-Cas systems according to the invention as described herein, such as the CRISPR-Cas systems for use in the methods according to the invention as described herein, may be suitably used for any type of application known for CRISPR-Cas systems, preferably in eukaryotes. In certain embodiments, the application is therapeutic, preferably therapeutic in a eukaryote organism, such as including but not limited to animals (including human), plants, algae, fungi (including yeasts), etc. Alternatively, or in addition, in certain embodiments, the application may involve accomplishing or inducing one or more particular traits or characteristics, such as genotypic and/or phenotypic traits or characteristics, as also described elsewhere herein.

Treating Diseases of the Circulatory System

In some embodiments, the CRISPR-Cas system and/or component thereof described herein can be used to treat and/or prevent a circulatory system disease. Exemplary diseases are provided, for example, in Tables 11 and 12, as well as a disease identified as being caused or attributed to a mtDNA mutation set forth at mitomap.org. In some embodiments the plasma exosomes of Wahlgren et al. (Nucleic Acids Research, 2012, Vol. 40, No. 17 e130) can be used to deliver the CRISPR-Cas system and/or component thereof described herein to the blood. In some embodiments, the circulatory system disease can be treated by using a lentivirus to deliver the CRISPR-Cas system described herein to modify hematopoietic stem cells (HSCs) in vivo or ex vivo (see e.g. Drakopoulou, "Review Article, The Ongoing Challenge of Hematopoietic Stem Cell-Based Gene Therapy for β-Thalassemia," Stem Cells International, Volume 2011, Article ID 987980, 10 pages, doi:10.4061/2011/987980, which can be adapted for use with the CRISPR-Cas systems herein in view of the description herein). In some embodiments, the circulatory system disorder can be treated by correcting HSCs as to the disease using a CRISPR-Cas system herein or a component thereof, wherein the CRISPR-Cas system optionally includes a suitable HDR repair template (see e.g. Cavazzana, "Outcomes of Gene Therapy for β-Thalassemia Major via Transplantation of Autologous Hematopoietic Stem Cells Transduced Ex vivo with a Lentiviral βA-T87Q-Globin Vector."; Cavazzana-Calvo, "Transfusion independence and HMGA2 activation after gene therapy of human β-thalassaemia", Nature 467, 318-322 (16 Sep. 2010) doi:10.1038/nature09328; Nienhuis, "Development of Gene Therapy for Thalassemia, Cold Spring Harbor Perspectives in Medicine, doi: 10.1101/cshperspect.a011833 (2012), LentiGlobin BB305, a lentiviral vector containing an engineered β-globin gene (PA-T87Q); and Xie et al., "Seamless gene correction of β-thalassaemia mutations in patient-specific iPSCs using CRISPR/Cas9 and piggyback" Genome Research gr.173427.114 (2014) http://www.genome.org/cgi/doi/10.1101/gr.173427.114 (Cold Spring Harbor Laboratory Press; [1599] Watts, "Hematopoietic Stem Cell Expansion and Gene Therapy" Cytotherapy 13(10):1164-1171. doi: 10.3109/14653249.2011.620748 (2011), which can be adapted for use with the CRISPR-Cas systems herein in view of the description herein). In some embodiments, iPSCs can be modified using a CRISPR-Cas system described herein to correct a disease polynucleotide associated with a circulatory disease. In this regard, the teachings of Xu et al. (Sci Rep. 2015 Jul. 9; 5:12065. doi: 10.1038/srep12065) and Song et al. (Stem Cells Dev. 2015 May 1; 24(9):1053-65. doi: 10.1089/scd.2014.0347. Epub 2015 Feb. 5) with respect to modifying iPSCs can be adapted for use in view of the description herein with the CRISPR-Cas systems described herein.

The term "Hematopoietic Stem Cell" or "HSC" refers broadly those cells considered to be an HSC, e.g., blood cells that give rise to all the other blood cells and are derived from mesoderm; located in the red bone marrow, which is contained in the core of most bones. HSCs of the invention include cells having a phenotype of hematopoietic stem cells, identified by small size, lack of lineage (lin) markers, and markers that belong to the cluster of differentiation series, like: CD34, CD38, CD90, CD133, CD105, CD45, and also c-kit, —the receptor for stem cell factor. Hematopoietic stem cells are negative for the markers that are used for detection of lineage commitment, and are, thus, called Lin-; and, during their purification by FACS, a number of up to 14 different mature blood-lineage markers, e.g., CD13 & CD33 for myeloid, CD71 for erythroid, CD19 for B cells, CD61 for megakaryocytic, etc. for humans; and, B220 (murine CD45) for B cells, Mac-1 (CD11b/CD18) for monocytes, Gr-1 for Granulocytes, Ter119 for erythroid cells, Il7Ra, CD3, CD4, CD5, CD8 for T cells, etc. Mouse HSC markers: CD34lo/−, SCA-1+, Thy1.1+/lo, CD38+, C-kit+, lin−, and Human HSC markers: CD34+, CD59+, Thy1/CD90+, CD38lo/−, C-kit/CD117+, and lin−. HSCs are identified by markers. Hence in embodiments discussed herein, the HSCs can be CD34+ cells. HSCs can also be hematopoietic stem cells that are CD34−/CD38−. Stem cells that may lack c-kit on the cell surface that are considered in the art as HSCs are within the ambit of the invention, as well as CD133+ cells likewise considered HSCs in the art.

In some embodiments, the treatment or prevention for treating a circulatory system or blood disease can include modifying a human cord blood cell with any modification described herein. In some embodiments, the treatment or prevention for treating a circulatory system or blood disease can include modifying a granulocyte colony-stimulating factor-mobilized peripheral blood cell (mPB) with any modification described herein. In some embodiments, the human cord blood cell or mPB can be CD34+. In some embodiments, the cord blood cell(s) or mPB cell(s) modified can be autologous. In some embodiments, the cord blood cell(s) or mPB cell(s) can be allogenic. In addition to the modification of the disease gene(s), allogenic cells can be further modified using the composition, system, described herein to reduce the immunogenicity of the cells when delivered to the recipient. Such techniques are described elsewhere herein and e.g. Cartier, "MINI-SYMPOSIUM:

X-Linked Adrenoleukodystrophy, Hematopoietic Stem Cell Transplantation and Hematopoietic Stem Cell Gene Therapy in X-Linked Adrenoleukodystrophy," Brain Pathology 20 (2010) 857-862, which can be adapted for use with the composition, system, herein. The modified cord blood cell(s) or mPB cell(s) can be optionally expanded in vitro. The modified cord blood cell(s) or mPB cell(s) can be derived to a subject in need thereof using any suitable delivery technique.

The CRISPR-Cas (system may be engineered to target genetic locus or loci in HSCs. In some embodiments, the Cas effector(s) can be codon-optimized for a eukaryotic cell and especially a mammalian cell, e.g., a human cell, for instance, HSC, or iPSC and sgRNA targeting a locus or loci in HSC, such as circulatory disease, can be prepared. These may be delivered via particles. The particles may be formed by the Cas effector (e.g., small Type II-D Cas) protein and the gRNA being admixed. The gRNA and Cas effector (e.g., small Type II-D Cas) protein mixture can be, for example, admixed with a mixture comprising or consisting essentially of or consisting of surfactant, phospholipid, biodegradable polymer, lipoprotein and alcohol, whereby particles containing the gRNA and Cas effector (e.g., small Type II-D Cas) protein may be formed. The invention comprehends so making particles and particles from such a method as well as uses thereof. Particles suitable delivery of the CRISRP-Cas systems in the context of blood or circulatory system or HSC delivery to the blood or circulatory system are described in greater detail elsewhere herein.

In some embodiments, after ex vivo modification the HSCs or iPCS can be expanded prior to administration to the subject. Expansion of HSCs can be via any suitable method such as that described by, Lee, "Improved ex vivo expansion of adult hematopoietic stem cells by overcoming CUL4-mediated degradation of HOXB4." Blood. 2013 May 16; 121(20):4082-9. doi: 10.1182/blood-2012-09-455204. Epub 2013 Mar. 21.

In some embodiments, the HSCs or iPSCs modified can be autologous. In some embodiments, the HSCs or iPSCs can be allogenic. In addition to the modification of the disease gene(s), allogenic cells can be further modified using the CRISPR-Cas system described herein to reduce the immunogenicity of the cells when delivered to the recipient. Such techniques are described elsewhere herein and e.g. Cartier, "MINI-SYMPOSIUM: X-Linked Adrenoleukodystrophypa, Hematopoietic Stem Cell Transplantation and Hematopoietic Stem Cell Gene Therapy in X-Linked Adrenoleukodystrophy," Brain Pathology 20 (2010) 857-862, which can be adapted for use with the CRISPR-Cas system herein.

Treating Diseases of the Brain

In some embodiments, the CRISPR-Cas systems described herein can be used to treat diseases of the brain and CNS. Delivery options for the brain include encapsulation of CRISPR enzyme and guide RNA in the form of either DNA or RNA into liposomes and conjugating to molecular Trojan horses for trans-blood brain barrier (BBB) delivery. Molecular Trojan horses have been shown to be effective for delivery of B-gal expression vectors into the brain of non-human primates. The same approach can be used to delivery vectors containing CRISPR enzyme and guide RNA. For instance, Xia C F and Boado R J, Pardridge W M ("Antibody-mediated targeting of siRNA via the human insulin receptor using avidin-biotin technology." Mol Pharm. 2009 May-June; 6(3):747-51. doi: 10.1021/mp800194) describes how delivery of short interfering RNA (siRNA) to cells in culture, and in vivo, is possible with combined use of a receptor-specific monoclonal antibody (mAb) and avidin-biotin technology. The authors also report that because the bond between the targeting mAb and the siRNA is stable with avidin-biotin technology, and RNAi effects at distant sites such as brain are observed in vivo following an intravenous administration of the targeted siRNA, the teachings of which can be adapted for use with the CRISPR-Cas systems herein. In other embodiments, an artificial virus can be generated for CNS and/or brain delivery. See e.g. Zhang et al. (Mol Ther. 2003 January; 7(1):11-8)), the teachings of which can be adapted for use with the CRISPR-Cas systems herein.

Treating Hearing Diseases

In some embodiments the CRISPR-Cas system described herein can be used to treat a hearing disease or hearing loss in one or both ears. Deafness is often caused by lost or damaged hair cells that cannot relay signals to auditory neurons. In such cases, cochlear implants may be used to respond to sound and transmit electrical signals to the nerve cells. But these neurons often degenerate and retract from the cochlea as fewer growth factors are released by impaired hair cells.

In some embodiments, the CRISPR-Cas system or modified cells can be delivered to one or both ears for treating or preventing hearing disease or loss by any suitable method or technique. Suitable methods and techniques include, but are not limited to, those set forth in US Patent Publication No. 20120328580 describes injection of a pharmaceutical composition into the ear (e.g., auricular administration), such as into the luminae of the cochlea (e.g., the Scala media, Sc vestibulae, and Sc tympani), e.g., using a syringe, e.g., a single-dose syringe. For example, one or more of the compounds described herein can be administered by intratympanic injection (e.g., into the middle ear), and/or injections into the outer, middle, and/or inner ear; administration in situ, via a catheter or pump (see e.g. McKenna et al., (U.S. Publication No. 2006/0030837) and Jacobsen et al., (U.S. Pat. No. 7,206,639); administration in combination with a mechanical device such as a cochlear implant or a hearing aid, which is worn in the outer ear (see e.g. U.S. Publication No. 2007/0093878, which provides an exemplary cochlear implant suitable for delivery of the CRISPR-Cas systems described herein to the ear). Such methods are routinely used in the art, for example, for the administration of steroids and antibiotics into human ears. Injection can be, for example, through the round window of the ear or through the cochlear capsule. Other inner ear administration methods are known in the art (see, e.g., Salt and Plontke, Drug Discovery Today, 10:1299-1306, 2005). In some embodiments, a catheter or pump can be positioned, e.g., in the ear (e.g., the outer, middle, and/or inner ear) of a patient during a surgical procedure. In some embodiments, a catheter or pump can be positioned, e.g., in the ear (e.g., the outer, middle, and/or inner ear) of a patient without the need for a surgical procedure.

In general, the cell therapy methods described in US Patent Publication No. 20120328580 can be used to promote complete or partial differentiation of a cell to or towards a mature cell type of the inner ear (e.g., a hair cell) in vitro. Cells resulting from such methods can then be transplanted or implanted into a patient in need of such treatment. The cell culture methods required to practice these methods, including methods for identifying and selecting suitable cell types, methods for promoting complete or partial differentiation of selected cells, methods for identifying complete or partially differentiated cell types, and methods for implanting complete or partially differentiated cells are described below.

Cells suitable for use in the present invention include, but are not limited to, cells that are capable of differentiating completely or partially into a mature cell of the inner ear, e.g., a hair cell (e.g., an inner and/or outer hair cell), when contacted, e.g., in vitro, with one or more of the compounds described herein. Exemplary cells that are capable of differentiating into a hair cell include, but are not limited to stem cells (e.g., inner ear stem cells, adult stem cells, bone marrow derived stem cells, embryonic stem cells, mesenchymal stem cells, skin stem cells, iPS cells, and fat derived stem cells), progenitor cells (e.g., inner ear progenitor cells), support cells (e.g., Deiters' cells, pillar cells, inner phalangeal cells, tectal cells and Hensen's cells), and/or germ cells. The use of stem cells for the replacement of inner ear sensory cells is described in Li et al., (U.S. Publication No. 2005/0287127) and Li et al., (U.S. patent application Ser. No. 11/953,797). The use of bone marrow derived stem cells for the replacement of inner ear sensory cells is described in Edge et al., PCT/US2007/084654. iPS cells are described, e.g., at Takahashi et al., Cell, Volume 131, Issue 5, Pages 861-872 (2007); Takahashi and Yamanaka, Cell 126, 663-76 (2006); Okita et al., Nature. 2007 Jul. 19; 448(7151):313-7; Yu, J. et al., Science 318(5858):1917-1920 (2007); Nakagawa et al., Nat. Biotechnol. 26:101-106 (2008); and Zaehres and Scholer, Cell 131(5):834-835 (2007). Such suitable cells can be identified by analyzing (e.g., qualitatively or quantitatively) the presence of one or more tissue specific genes. For example, gene expression can be detected by detecting the protein product of one or more tissue-specific genes. Protein detection techniques involve staining proteins (e.g., using cell extracts or whole cells) using antibodies against the appropriate antigen. In this case, the appropriate antigen is the protein product of the tissue-specific gene expression. Although, in principle, a first antibody (i.e., the antibody that binds the antigen) can be labeled, it is more common (and improves the visualization) to use a second antibody directed against the first (e.g., an anti-IgG). This second antibody is conjugated either with fluorochromes, or appropriate enzymes for colorimetric reactions, or gold beads (for electron microscopy), or with the biotin-avidin system, so that the location of the primary antibody, and thus the antigen, can be recognized.

The CRISPR Cas molecules of the present invention may be delivered to the ear by direct application of pharmaceutical composition to the outer ear, with compositions modified from US Published application, 20110142917. In some embodiments the pharmaceutical composition is applied to the ear canal. Delivery to the ear may also be referred to as aural or otic delivery.

In some embodiments, the CRISPR-Cas systems or components thereof and/or vectors or vector systems can be delivered to ear via a transfection to the inner ear through the intact round window by a novel proteidic delivery technology which may be applied to the nucleic acid-targeting system of the present invention (see, e.g., Qi et al., Gene Therapy volume 21, pages 10-18 (2014) nature.com/articles/gt201349. About 40 μl of 10 mM RNA may be contemplated as the dosage for administration to the ear.

According to Rejali et al. (Hear Res. 2007 June; 228(1-2):180-7), cochlear implant function can be improved by good preservation of the spiral ganglion neurons, which are the target of electrical stimulation by the implant and brain derived neurotrophic factor (BDNF) has previously been shown to enhance spiral ganglion survival in experimentally deafened ears. Rejali et al. tested a modified design of the cochlear implant electrode that includes a coating of fibroblast cells transduced by a viral vector with a BDNF gene insert. To accomplish this type of ex vivo gene transfer, Rejali et al. transduced guinea pig fibroblasts with an adenovirus with a BDNF gene cassette insert, and determined that these cells secreted BDNF and then attached BDNF-secreting cells to the cochlear implant electrode via an agarose gel, and implanted the electrode in the scala tympani. Rejali et al. determined that the BDNF expressing electrodes were able to preserve significantly more spiral ganglion neurons in the basal turns of the cochlea after 48 days of implantation when compared to control electrodes and demonstrated the feasibility of combining cochlear implant therapy with ex vivo gene transfer for enhancing spiral ganglion neuron survival. Such a system may be applied to the nucleic acid-targeting system of the present invention for delivery to the ear.

In some embodiments, the system set forth in Mukherjea et al. Antioxid Redox Signal. 2010 Sep. 1; 13(5): 589-598 can be adapted for transtympanic administration of the CRISPR-Cas system or component thereof to the ear. In some embodiments, a dosage of about 2 mg to about 4 mg of CRISPR Cas for administration to a human.

In some embodiments, the system set forth in [Jung et al. (Molecular Therapy, vol. 21 no. 4, 834-841 April 2013) can be adapted for vestibular epithelial delivery of the CRISPR-Cas system or component thereof to the ear. In some embodiments, a dosage of about 1 to about 30 mg of CRISPR Cas for administration to a human.

Treating Diseases in Non-Dividing Cells

In some embodiments, the gene or transcript to be corrected is in a non-dividing cell. Exemplary non-dividing cells are muscle cells or neurons. Non-dividing (especially non-dividing, fully differentiated) cell types present issues for gene targeting or genome engineering, for example because homologous recombination (HR) is generally suppressed in the G1 cell-cycle phase. However, while studying the mechanisms by which cells control normal DNA repair systems, Durocher discovered a previously unknown switch that keeps HR "off" in non-dividing cells and devised a strategy to toggle this switch back on. Orthwein et al. (Daniel Durocher's lab at the Mount Sinai Hospital in Ottawa, Canada) recently reported (Nature 16142, published online 9 Dec. 2015) have shown that the suppression of HR can be lifted and gene targeting successfully concluded in both kidney (293T) and osteosarcoma (U20S) cells. Tumor suppressors, BRCA1, PALB2 and BRAC2 are known to promote DNA DSB repair by HR. They found that formation of a complex of BRCA1 with PALB2-BRAC2 is governed by a ubiquitin site on PALB2, such that action on the site by an E3 ubiquitin ligase. This E3 ubiquitin ligase is composed of KEAP1 (a PALB2-interacting protein) in complex with cullin-3 (CUL3)-RBX1. PALB2 ubiquitylation suppresses its interaction with BRCA1 and is counteracted by the deubiquitylase USP11, which is itself under cell cycle control. Restoration of the BRCA1-PALB2 interaction combined with the activation of DNA-end resection is sufficient to induce homologous recombination in G1, as measured by a number of methods including a CRISPR-Cas9-based gene-targeting assay directed at USP11 or KEAP1 (expressed from a pX459 vector). However, when the BRCA1-PALB2 interaction was restored in resection-competent G1 cells using either KEAP1 depletion or expression of the PALB2-KR mutant, a robust increase in gene-targeting events was detected. These teachings can be adapted for and/or applied to the small Type II-D CRISPR-Cas systems described herein.

Thus, reactivation of HR in cells, especially non-dividing, fully differentiated cell types is preferred, in some embodiments. In some embodiments, promotion of the BRCA1-PALB2 interaction is preferred in some embodiments. In some embodiments, the target ell is a non-dividing cell. In some embodiments, the target cell is a neuron or muscle cell. In some embodiments, the target cell is targeted in vivo. In some embodiments, the cell is in G1 and HR is suppressed. In some embodiments, use of KEAP1 depletion, for example inhibition of expression of KEAP1 activity, is preferred. KEAP1 depletion may be achieved through siRNA, for example as shown in Orthwein et al. Alternatively, expression of the PALB2-KR mutant (lacking all eight Lys residues in the BRCA1-interaction domain is preferred, either in combination with KEAP1 depletion or alone. PALB2-KR interacts with BRCA1 irrespective of cell cycle position. Thus, promotion or restoration of the BRCA1-PALB2 interaction, especially in G1 cells, is preferred in some embodiments, especially where the target cells are non-dividing, or where removal and return (ex vivo gene targeting) is problematic, for example neuron or muscle cells. KEAP1 siRNA is available from Thermo Fischer. In some embodiments, a BRCA1-PALB2 complex may be delivered to the G1 cell. In some embodiments, PALB2 deubiquitylation may be promoted for example by increased expression of the deubiquitylase USP11, so it is envisaged that a construct may be provided to promote or up-regulate expression or activity of the deubiquitylase USP11.

Treating Diseases of the Eye

In some embodiments, the disease to be treated is a disease that affects the eyes. Thus, in some embodiments, the CRISPR-Cas system or component thereof described herein is delivered to one or both eyes.

The CRISPR-Cas system can be used to correct ocular defects that arise from several genetic mutations further described in Genetic Diseases of the Eye, Second Edition, edited by Elias I. Traboulsi, Oxford University Press, 2012.

In some embodiments, the condition to be treated or targeted is an eye disorder. In some embodiments, the eye disorder may include glaucoma. In some embodiments, the eye disorder includes a retinal degenerative disease. In some embodiments, the retinal degenerative disease is selected from Stargardt disease, Bardet-Biedl Syndrome, Best disease, Blue Cone Monochromacy, Choroideremia, Cone-rod dystrophy, Congenital Stationary Night Blindness, Enhanced S-Cone Syndrome, Juvenile X-Linked Retinoschisis, Leber Congenital Amaurosis, Malattia Leventinese, Norrie Disease or X-linked Familial Exudative Vitreoretinopathy, Pattern Dystrophy, Sorsby Dystrophy, Usher Syndrome, Retinitis Pigmentosa, Achromatopsia or Macular dystrophies or degeneration, Retinitis Pigmentosa, Achromatopsia, and age related macular degeneration. In some embodiments, the retinal degenerative disease is Leber Congenital Amaurosis (LCA) or Retinitis Pigmentosa. Other exemplary eye diseases are described in greater detail elsewhere herein.

In some embodiments, the CRISPR-Cas system is delivered to the eye, optionally via intravitreal injection or subretinal injection. Intraocular injections may be performed with the aid of an operating microscope. For subretinal and intravitreal injections, eyes may be prolapsed by gentle digital pressure and fundi visualized using a contact lens system consisting of a drop of a coupling medium solution on the cornea covered with a glass microscope slide coverslip. For subretinal injections, the tip of a 10-mm 34-gauge needle, mounted on a 5-µl Hamilton syringe may be advanced under direct visualization through the superior equatorial sclera tangentially towards the posterior pole until the aperture of the needle was visible in the subretinal space. Then, 2 µl of vector suspension may be injected to produce a superior bullous retinal detachment, thus confirming subretinal vector administration. This approach creates a self-sealing sclerotomy allowing the vector suspension to be retained in the subretinal space until it is absorbed by the RPE, usually within 48 h of the procedure. This procedure may be repeated in the inferior hemisphere to produce an inferior retinal detachment. This technique results in the exposure of approximately 70% of neurosensory retina and RPE to the vector suspension. For intravitreal injections, the needle tip may be advanced through the sclera 1 mm posterior to the corneoscleral limbus and 2 µl of vector suspension injected into the vitreous cavity. For intracameral injections, the needle tip may be advanced through a corneoscleral limbal paracentesis, directed towards the central cornea, and 2 µl of vector suspension may be injected. For intracameral injections, the needle tip may be advanced through a corneoscleral limbal paracentesis, directed towards the central cornea, and 2 µl of vector suspension may be injected. These vectors may be injected at titers of either $1.0–1.4\times10^{10}$ or $1.0–1.4\times10^{9}$ transducing units (TU)/ml.

In some embodiments, for administration to the eye, lentiviral vectors. In some embodiments, the lentiviral vector is an equine infectious anemia virus (EIAV) vector. Exemplary EIAV vectors for eye delivery are described in Balagaan, J Gene Med 2006; 8: 275-285, Published online 21 Nov. 2005 in Wiley InterScience (www.interscience.wiley.com). DOI: 10.1002/jgm.845; Binley et al., HUMAN GENE THERAPY 23:980-991 (September 2012), which can be adapted for use with the CRISPR-Cas system described herein. In some embodiments, the dosage can be $1.1\times10^{5}$ transducing units per eye (TU/eye) in a total volume of 100 µl.

Other viral vectors can also be used for delivery to the eye, such as AAV vectors, such as those described in Campochiaro et al., Human Gene Therapy 17:167-176 (February 2006), Millington-Ward et al. (Molecular Therapy, vol. 19 no. 4, 642-649 April 2011; Dalkara et al. (Sci Transl Med 5, 189 ra76 (2013)), which can be adapted for use with the CRISPR-Cas system described herein. In some embodiments, the dose can range from about $10^{6}$ to $10^{9.5}$ particle units. In the context of the Millington-Ward AAV vectors, a dose of about $2\times10^{11}$ to about $6\times10^{13}$ virus particles can be administered. In the context of Dalkara vectors, a dose of about $1\times10^{15}$ to about $1\times10^{16}$ vg/ml administered to a human.

In some embodiments, the sd-rxRNA® system of RXi Pharmaceuticals may be used/ and or adapted for delivering CRISPR-Cas system to the eye. In this system, a single intravitreal administration of 3 µg of sd-rxRNA results in sequence-specific reduction of PPIB mRNA levels for 14 days. The sd-rxRNA® system may be applied to the nucleic acid-targeting system of the present invention, contemplating a dose of about 3 to 20 mg of CRISPR administered to a human.

In other embodiments, the methods of US Patent Publication No. 20130183282, which is directed to methods of cleaving a target sequence from the human rhodopsin gene, may also be modified to the nucleic acid-targeting system of the present invention.

In other embodiments, the methods of US Patent Publication No. 20130202678 for treating retinopathies and sight-threatening ophthalmologic disorders relating to delivering of the Puf-A gene (which is expressed in retinal ganglion and pigmented cells of eye tissues and displays a unique anti-apoptotic activity) to the sub-retinal or intravitreal space in the eye. In particular, desirable targets are zgc:193933, prdm1a, spata2, tex10, rbb4, ddx3, zp2.2, Blimp-1 and HtrA2, all of which may be targeted by the CRISPR-Cas system of the present invention.

Wu (Cell Stem Cell, 13:659-62, 2013) designed a guide RNA that led Cas9 to a single base pair mutation that causes cataracts in mice, where it induced DNA cleavage. Then using either the other wild-type allele or oligos given to the zygotes repair mechanisms corrected the sequence of the broken allele and corrected the cataract-causing genetic defect in mutant mouse. This approach can be adapted to and/or applied to the small Type II-D CRISPR-Cas systems described herein.

US Patent Publication No. 20120159653, describes use of zinc finger nucleases to genetically modify cells, animals and proteins associated with macular degeneration (MD), the teachings of which can be applied to and/or adapted for the CRISPR-Cas systems described herein.

One aspect of US Patent Publication No. 20120159653 relates to editing of any chromosomal sequences that encode proteins associated with MD which may be applied to the nucleic acid-targeting system of the present invention.

Treating Muscle Diseases and Cardiovascular Diseases

In some embodiments, the CRISPR-Cas system can be used to treat and/or prevent a muscle disease and associated circulatory or cardiovascular disease or disorder. The present invention also contemplates delivering the CRISPR-Cas system described herein, e.g. Cas effector protein systems, to the heart. For the heart, a myocardium tropic adeno-associated virus (AAVM) is preferred, in particular AAVM41 which showed preferential gene transfer in the heart (see, e.g., Yang et al., Proc. Natl. Acad. Sci. 106 (10) 3946-3951 pnas.org/doi/abs/10.073/pnas.0813207106. Administration may be systemic or local. A dosage of about $1-10 \times 10^{14}$ vector genomes are contemplated for systemic administration. See also, e.g., Eulalio et al. (2012) Nature 492: 376 and Somasuntharam et al. (2013) Biomaterials 34: 7790, the teachings of which can be adapted for and/or applied to the CRISPR-Cas systems described herein.

For example, US Patent Publication No. 20110023139, the teachings of which can be adapted for and/or applied to the CRISPR-Cas systems described herein describes use of zinc finger nucleases to genetically modify cells, animals and proteins associated with cardiovascular disease. Cardiovascular diseases generally include high blood pressure, heart attacks, heart failure, and stroke and TIA. Any chromosomal sequence involved in cardiovascular disease or the protein encoded by any chromosomal sequence involved in cardiovascular disease may be utilized in the methods described in this disclosure. The cardiovascular-related proteins are typically selected based on an experimental association of the cardiovascular-related protein to the development of cardiovascular disease. For example, the production rate or circulating concentration of a cardiovascular-related protein may be elevated or depressed in a population having a cardiovascular disorder relative to a population lacking the cardiovascular disorder. Differences in protein levels may be assessed using proteomic techniques including but not limited to Western blot, immunohistochemical staining, enzyme linked immunosorbent assay (ELISA), and mass spectrometry. Alternatively, the cardiovascular-related proteins may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

The CRISPR-Cas systems herein can be used for treating diseases of the muscular system. The present invention also contemplates delivering the CRISPR-Cas system described herein, e.g., small Type II-D Cas effector protein systems, to muscle(s).

In some embodiments, the muscle disease to be treated is a muscle dystrophy such as DMD. In some embodiments, the CRISPR-Cas system, such as a system capable of RNA modification, described herein can be used to achieve exon skipping to achieve correction of the diseased gene. As used herein, the term "exon skipping" refers to the modification of pre-mRNA splicing by the targeting of splice donor and/or acceptor sites within a pre-mRNA with one or more complementary antisense oligonucleotide(s) (AONs). By blocking access of a spliceosome to one or more splice donor or acceptor site, an AON may prevent a splicing reaction thereby causing the deletion of one or more exons from a fully-processed mRNA. Exon skipping may be achieved in the nucleus during the maturation process of pre-mRNAs. In some examples, exon skipping may include the masking of key sequences involved in the splicing of targeted exons by using a CRISPR-Cas system described herein capable of RNA modification. In some embodiments, exon skipping can be achieved in dystrophin mRNA. In some embodiments, the CRISPR-Cas system can induce exon skipping at exon 1, 2, 3, 4, 5, 6, 7, 8, 10, 11, 12, 13, 14, 15, 16, 17, 18, 19, 20, 21, 22, 23, 24, 25, 26, 27, 28, 29, 30, 31, 32, 33, 34, 45, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or any combination thereof of the dystrophin mRNA. In some embodiments, the CRISPR-Cas system can induce exon skipping at exon 43, 44, 50, 51, 52, 55, or any combination thereof of the dystrophin mRNA. Mutations in these exons, can also be corrected using non-exon skipping polynucleotide modification methods.

In some embodiments, for treatment of a muscle disease, the method of Bortolanza et al. Molecular Therapy vol. 19 no. 11, 2055-264 November 2011) may be applied to an AAV expressing CRISPR Cas and injected into humans at a dosage of about $2 \times 10^{15}$ or $2 \times 10^{16}$ vg of vector. The teachings of Bortolanza et al., can be adapted for and/or applied to the CRISPR-Cas systems described herein.

In some embodiments, the method of Dumonceaux et al. (Molecular Therapy vol. 18 no. 5, 881-887 May 2010) may be applied to an AAV expressing CRISPR Cas and injected into humans, for example, at a dosage of about $10^{14}$ to about $10^{15}$ vg of vector. The teachings of Dumonceaux described herein can be adapted for and/or applied to the CRISPR-Cas systems described herein.

In some embodiments, the method of Kinouchi et al. (Gene Therapy (2008) 15, 1126-1130) may be applied to CRISPR Cas systems described herein and injected into a human, for example, at a dosage of about 500 to 1000 ml of a 40 µM solution into the muscle.

In some embodiments, the method of Hagstrom et al. (Molecular Therapy Vol. 10, No. 2, August 2004) can be adapted for and/or applied to the CRISPR-Cas systems herein and injected at a dose of about 15 to about 50 mg into the great saphenous vein of a human.

Treating Diseases of the Liver and Kidney

In some embodiments, the CRISPR-Cas system or component thereof described herein can be used to treat a disease of the kidney or liver. Thus, in some embodiments, delivery of the CRISRP-Cas system or component thereof described herein is to the liver or kidney.

Delivery strategies to induce cellular uptake of the therapeutic nucleic acid include physical force or vector systems such as viral-, lipid- or complex-based delivery, or nanocarriers. From the initial applications with less possible clinical relevance, when nucleic acids were addressed to renal cells with hydrodynamic high-pressure injection systemically, a wide range of gene therapeutic viral and non-viral carriers have been applied already to target posttranscriptional events in different animal kidney disease models in vivo (Csaba Révész and Péter Hamar (2011). Delivery Methods to Target RNAs in the Kidney, Gene Therapy Applications, Prof. Chunsheng Kang (Ed.), ISBN: 978-953-307-541-9, InTech, Available from: www.intechopen.com/books/gene-therapy-applications/delivery-methods-to-target-rnas-inthe-kidney). Delivery methods to the kidney may include those in Yuan et al. (Am J Physiol Renal Physiol 295: F605-F617, 2008). The method of Yuang et al. may be applied to the CRISPR Cas system of the present invention contemplating a 1-2 g subcutaneous injection of CRISPR Cas conjugated with cholesterol to a human for delivery to the kidneys. In some embodiments, the method of Molitoris et al. (J Am Soc Nephrol 20: 1754-1764, 2009) can be adapted to the CRISRP-Cas system of the present invention and a cumulative dose of 12-20 mg/kg to a human can be used for delivery to the proximal tubule cells of the kidneys. In some embodiments, the methods of Thompson et al. (Nucleic Acid Therapeutics, Volume 22, Number 4, 2012) can be adapted to the CRISRP-Cas system of the present invention and a dose of up to 25 mg/kg can be delivered via i.v. administration. In some embodiments, the method of Shimizu et al. (J Am Soc Nephrol 21: 622-633, 2010) can be adapted to the CRISRP-Cas system of the present invention and a dose of about of 10-20 µmol CRISPR Cas complexed with nanocarriers in about 1-2 liters of a physiologic fluid for i.p. administration can be used.

Other various delivery vehicles can be used to deliver the CRISPR-Cas system to the kidney such as viral, hydrodynamic, lipid, polymer nanoparticles, aptamers and various combinations thereof (see e.g. Larson et al., Surgery, (August 2007), Vol. 142, No. 2, pp. (262-269); Hamar et al., Proc Natl Acad Sci, (October 2004), Vol. 101, No. 41, pp. (14883-14888); Zheng et al., Am J Pathol, (October 2008), Vol. 173, No. 4, pp. (973-980); Feng et al., Transplantation, (May 2009), Vol. 87, No. 9, pp. (1283-1289); Q. Zhang et al., PloS ONE, (July 2010), Vol. 5, No. 7, e11709, pp. (1-13); Kushibikia et al., J Controlled Release, (July 2005), Vol. 105, No. 3, pp. (318-331); Wang et al., Gene Therapy, (July 2006), Vol. 13, No. 14, pp. (1097-1103); Kobayashi et al., Journal of Pharmacology and Experimental Therapeutics, (February 2004), Vol. 308, No. 2, pp. (688-693); Wolfrum et al., Nature Biotechnology, (September 2007), Vol. 25, No. 10, pp. (1149-1157); Molitoris et al., J Am Soc Nephrol, (August 2009), Vol. 20, No. 8 pp. (1754-1764); Mikhaylova et al., Cancer Gene Therapy, (March 2011), Vol. 16, No. 3, pp. (217-226); Y. Zhang et al., J Am Soc Nephrol, (April 2006), Vol. 17, No. 4, pp. (1090-1101); Singhal et al., Cancer Res, (May 2009), Vol. 69, No. 10, pp. (4244-4251); Malek et al., Toxicology and Applied Pharmacology, (April 2009), Vol. 236, No. 1, pp. (97-108); Shimizu et al., J Am Soc Nephrology, (April 2010), Vol. 21, No. 4, pp. (622-633); Jiang et al., Molecular Pharmaceutics, (May-June 2009), Vol. 6, No. 3, pp. (727-737); Cao et al, J Controlled Release, (June 2010), Vol. 144, No. 2, pp. (203-212); Ninichuk et al., Am J Pathol, (March 2008), Vol. 172, No. 3, pp. (628-637); Purschke et al., Proc Natl Acad Sci, (March 2006), Vol. 103, No. 13, pp. (5173-5178).

In some embodiments, delivery is to liver cells. In some embodiments, the liver cell is a hepatocyte. Delivery of the CRISPR protein, such as Cas effector (e.g., small Type II-D Cas) herein may be via viral vectors, especially AAV (and in particular AAV2/6) vectors. These can be administered by intravenous injection. A preferred target for the liver, whether in vitro or in vivo, is the albumin gene. This is a so-called "safe harbor" as albumin is expressed at very high levels and so some reduction in the production of albumin following successful gene editing is tolerated. It is also preferred as the high levels of expression seen from the albumin promoter/enhancer allows for useful levels of correct or transgene production (from the inserted donor template) to be achieved even if only a small fraction of hepatocytes are edited. See sites identified by Wechsler et al., Blood (2015) 126 (23): 200 doi.org/10.1182/blood.V126.23.200.200 and presented on 6 Dec. 2015) which can be adapted for use with the CRISPR-Cas systems herein.

Exemplary liver and kidney diseases that can be treated and/or prevented are described elsewhere herein.

Treating Epithelial and Lung Diseases

In some embodiments, the disease treated or prevented by the CRISPR-Cas system described herein can be a lung or epithelial disease. The CRISPR-Cas systems described herein can be used for treating epithelial and/or lung diseases. The present invention also contemplates delivering the CRISPR-Cas system described herein, e.g., small Type II-D Cas effector systems, to one or both lungs.

In some embodiments, as viral vector can be used to deliver the CRISPR-Cas system or component thereof to the lungs. In some embodiments, the AAV is an AAV-1, AAV-2, AAV-5, AAV-6, and/or AAV-9 for delivery to the lungs. (see, e.g., Li et al., Molecular Therapy, vol. 17 no. 12, 2067-277 December 2009). In some embodiments, the MOI can vary from $1 \times 10^3$ to $4 \times 10^5$ vector genomes/cell. In some embodiments, the delivery vector can be an RSV vector as in Zamora et al. (Am J Respir Crit Care Med Vol 183. pp 531-538, 2011. The method of Zamora et al. may be applied to the nucleic acid-targeting system of the present invention and an aerosolized CRISPR Cas, for example with a dosage of 0.6 mg/kg, may be contemplated for the present invention.

Subjects treated for a lung disease may for example receive pharmaceutically effective amount of aerosolized AAV vector system per lung endobronchially delivered while spontaneously breathing. As such, aerosolized delivery is preferred for AAV delivery in general. An adenovirus or an AAV particle may be used for delivery. Suitable gene constructs, each operably linked to one or more regulatory sequences, may be cloned into the delivery vector. In this instance, the following constructs are provided as examples: Cbh or EF1a promoter for Cas (small Type II-D Cas), U6 or H1 promoter for guide RNA). A preferred arrangement is to use a CFTRdelta508 targeting guide, a repair template for deltaF508 mutation and a codon optimized Cas (e.g., small Type II-D Cas) enzyme, with optionally one or more nuclear localization signal or sequence(s) (NLS(s)), e.g., two (2) NLSs.

Treating Diseases of the Skin

The CRISPR-Cas systems described herein can be used for the treatment of skin diseases. The present invention also contemplates delivering the CRISPR-Cas system described herein, e.g., small Type II-D Cas effector protein systems, to the skin.

In some embodiments, delivery to the skin (intradermal delivery) of the CRISPR-Cas system or component thereof can be via one or more microneedles or microneedle containing device. For example, in some embodiments the device and methods of Hickerson et al. (Molecular Therapy—Nucleic Acids (2013) 2, e129) can be used and/or adapted to deliver the CRISPR-Cas system described herein, for example, at a dosage of up to 300 µl of 0.1 mg/ml CRISPR-Cas (e.g., small Type II-D Cas) system to the skin.

In some embodiments, the methods and techniques of Leachman et al. (Molecular Therapy, vol. 18 no. 2, 442-446 February 2010) can be used and/or adapted for delivery of a CIRPSR-Cas system described herein to the skin.

In some embodiments, the methods and techniques of Zheng et al. (PNAS, Jul. 24, 2012, vol. 109, no. 30, 11975-11980) can be used and/or adapted for nanoparticle delivery of a CIRPSR-Cas system described herein to the skin. In some embodiments, as dosage of about 25 nM applied in a single application can achieve gene knockdown in the skin.

Treating Cancer

The CRISPR-Cas systems described herein can be used for the treatment of cancer. The present invention also contemplates delivering the CRISPR-Cas system described herein, e.g., small Type II-D Cas effector protein systems, to a cancer cell. Also, as is described elsewhere herein the CRISPR-Cas systems can be used to modify an immune cell, such as a CAR or CAR T cell, which can then in turn be used to treat and/or prevent cancer. This is also described in WO2015161276, the disclosure of which is hereby incorporated by reference and described herein below.

Target genes suitable for the treatment or prophylaxis of cancer can include those set forth in Tables 11 and 12 and those identified at mitoMap.org. In some embodiments, target genes for cancer treatment and prevention can also include those described in WO2015048577 the disclosure of which is hereby incorporated by reference and can be adapted for and/or applied to the CRISPR-Cas system described herein.

Diseases

Genetic Diseases and Diseases with a Genetic and/or Epigenetic Aspect

The CRISPR-Cas systems or components thereof can be used to treat and/or prevent a genetic disease or a disease with a genetic and/or epigenetic aspect. The genes and conditions exemplified herein are not exhaustive. In some embodiments, a method of treating and/or preventing a genetic disease can include administering a CRISPR-Cas system and/or one or more components thereof to a subject, where the CRISPR-Cas system and/or one or more components thereof is capable of modifying one or more copies of one or more genes associated with the genetic disease or a disease with a genetic and/or epigenetic aspect in one or more cells of the subject. In some embodiments, modifying one or more copies of one or more genes associated with a genetic disease or a disease with a genetic and/or epigenetic aspect in the subject can eliminate a genetic disease or a symptom thereof in the subject. In some embodiments, modifying one or more copies of one or more genes associated with a genetic disease or a disease with a genetic and/or epigenetic aspect in the subject can decrease the severity of a genetic disease or a symptom thereof in the subject. In some embodiments, the CRISPR-Cas systems or components thereof can modify one or more genes or polynucleotides associated with one or more diseases, including genetic diseases and/or those having a genetic aspect and/or epigenetic aspect, including but not limited to, any one or more set forth in Table 11. It will be appreciated that those diseases and associated genes listed herein are non-exhaustive and non-limiting. Further some genes play roles in the development of multiple diseases.

TABLE 11

Exemplary Genetic and Other Diseases and Associated Genes

| Disease Name | Primary Tissues or System Affected | Additional Tissues/Systems Affected | Genes |
| --- | --- | --- | --- |
| Achondroplasia | Bone and Muscle | | fibroblast growth factor receptor 3 (FGFR3) |
| Achromatopsia | eye | | CNGA3, CNGB3, GNAT2, PDE6C, PDE6H, ACHM2, ACHM3, |
| Acute Renal Injury | kidney | | NFkappaB, AATF, p85alpha, FAS, Apoptosis cascade elements (e.g. FASR, Caspase 2, 3, 4, 6, 7, 8, 9, 10, AKT, TNF alpha, IGF1, IGF1R, RIPK1), p53 |
| Age Related Macular Degeneration | eye | | Abcr; CCL2; CC2; CP (ceruloplasmin); Timp3; cathepsinD; VLDLR, CCR2 |
| AIDS | Immune System | | KIR3DL1, NKAT3, NKB1, AMB11, KIR3DS1, IFNG, CXCL12, SDF1 |
| Albinism (including oculocutaneous albinism (types 1-7) and ocular albinism) | Skin, hair, eyes, | | TYR, OCA2, TYRP1, and SLC45A2, SLC24A5 and C10orf11 |
| Alkaptonuria | Metabolism of amino acids | Tissues/organs where homogentisic acid accumulates, particularly cartilage (joints), heart valves, kidneys | HGD |

TABLE 11-continued

Exemplary Genetic and Other Diseases and Associated Genes

| Disease Name | Primary Tissues or System Affected | Additional Tissues/Systems Affected | Genes |
|---|---|---|---|
| alpha-1 antitrypsin deficiency (AATD or A1AD) | Lung | Liver, skin, vascular system, kidneys, GI | SERPINA1, those set forth in WO2017165862, PiZ allele |
| ALS | CNS | | SOD1; ALS2; ALS3; ALS5; ALS7; STEX; FUS; TARDBP; VEGF (VEGF-a; VEGF-b; VEGF-c); DPP6; NEFH, PTGS1, SLC1A2, TNFRSF10B, PRPH, HSP90AA1, CRIA2, IFNG, AMPA2 S100B, FGF2, AOX1, CS, TXN, RAPHJ1, MAP3K5, NBEAL1, GPX1, ICA1L, RAC1, MAPT, ITPR2, ALS2CR4, GLS, ALS2CR8, CNTFR, ALS2CR11, FOLH1, FAM117B, P4HB, CNTF, SQSTM1, STRADB, NAIP, NLR, YWHAQ, SLC33A1, TRAK2, SCA1, NIF3L1, NIF3, PARD3B, COX8A, CDK15, HECW1, HECT, C2, WW 15, NOS1, MET, SOD2, HSPB1, NEFL, CTSB, ANG, HSPA8, RNase A, VAPB, VAMP, SNCA, alpha HGF, CAT, ACTB, NEFM, TH, BCL2, FAS, CASP3, CLU, SMN1, G6PD, BAX, HSF1, RNF19A, JUN, ALS2CR12, HSPA5, MAPK14, APEX1, TXNRD1, NOS2, TIMP1, CASP9, XIAP, GLG1, EPO, VEGFA, ELN, GDNF, NFE2L2, SLC6A3, HSPA4, APOE, PSMB8, DCTN2, TIMP3, KIFAP3, SLC1A1, SMN2, CCNC, STUB1, ALS2, PRDX6, SYP, CABIN1, CASP1, GART, CDK5, ATXN3, RTN4, C1QB, VEGFC, HTT, PARK7, XDH, GFAP, MAP2, CYCS, FCGR3B, CCS, UBL5, MMP9m SLC18A3, TRPM7, HSPB2, AKT1, DEERL1, CCL2, NGRN, GSR, TPPP3, APAF1, BTBD10, GLUD1, CXCR4, S:C1A3, FLT1, PON1, AR, LIF, ERBB3, :GA:S1, CD44, TP53, TLR3, GRIA1, GAPDH, AMPA, GRIK1, DES, CHAT, FLT4, CHMP2B, BAG1, CHRNA4, GSS, BAK1, KDR, GSTP1, OGG1, IL6 |
| Alzheimer's Disease | Brain | | E1; CHIP; UCH; UBB; Tau; LRP; PICALM; CLU; PS1; SORL1; CR1; VLDLR; UBA1; UBA3; CHIP28; AQP1; UCHL1; UCHL3; APP, AAA, CVAP, AD1, APOE, AD2, DCP1, ACE1, MPO, PACIP1, PAXIP1L, PTIP, A2M, BLMH, BMH, PSEN1, AD3, ALAS2, ABCA1, BIN1, BDNF, BTNL8, C1ORF49, CDH4, CHRNB2, CKLFSF2, CLEC4E, CR1L, CSF3R, CST3, CYP2C, DAPK1, ESR1, FCAR, FCGR3B, FFA2, FGA, GAB2, GALP, GAPDHS, GMPB, HP, HTR7, IDE, IF127, IFI6, IFIT2, IL1RN, IL-1RA, IL8RA, IL8RB, JAG1, KCNJ15, LRP6, MAPT, MARK4, MPHOSPH1, MTHFR, NBN, NCSTN, NIACR2, NMNAT3, NTM, ORM1, P2RY13, PBEF1, PCK1, PICALM, PLAU, PLXNC1, PRNP, PSEN1, PSEN2, PTPRA, RALGPS2, RGSL2, SELENBP1, SLC25A37, SORL1, Mitoferrin-1, TF, TFAM, TNF, TNFRSF10C, UBE1C |
| Amyloidosis | | | APOA1, APP, AAA, CVAP, AD1, GSN, FGA, LYZ, TTR, PALB |

TABLE 11-continued

Exemplary Genetic and Other Diseases and Associated Genes

| Disease Name | Primary Tissues or System Affected | Additional Tissues/Systems Affected | Genes |
|---|---|---|---|
| Amyloid neuropathy | | | TTR, PALB |
| Anemia | Blood | | CDAN1, CDA1, RPS19, DBA, PKLR, PK1, NT5C3, UMPH1, PSN1, RHAG, RH50A, NRAMP2, SPTB, ALAS2, ANH1, ASB, ABCB7, ABC7, ASAT |
| Angelman Syndrome | Nervous system, brain | | UBE3A |
| Attention Deficit Hyperactivity Disorder (ADHD) | Brain | | PTCHD1 |
| Autoimmune lymphoproliferative syndrome | Immune system | | TNFRSF6, APT1, FAS, CD95, ALPS1A |
| Autism, Autism spectrum disorders (ASDs), including Asperger's and a general diagnostic category called Pervasive Developmental Disorders (PDDs) | Brain | | PTCHD1; Mecp2; BZRAP1; MDGA2; Sema5A; Neurexin 1; GLO1, RTT, PPMX, MRX16, RX79, NLGN3, NLGN4, KIAA1260, AUTSX2, FMRI, FMR2; FXR1; FXR2; MGLUR5, ATP10C, CDH10, GRM6, MGLUR6, CDH9, CNTN4, NLGN2, CNTNAP2, SEMA5A, DHCR7, NLGN4X, NLGN4Y, DPP6, NLGN5, EN2, NRCAM, MDGA2, NRXN1, FMR2, AFF2, FOXP2, OR4M2, OXTR, FXR1, FXR2, PAH, GABRA1, PTEN, GABRA5, PTPRZ1, GABRB3, GABRG1, HIRIP3, SEZ6L2, HOXA1, SHANK3, IL6, SHBZRAP1, LAMB1, SLC6A4, SERT, MAPK3, TAS2R1, MAZ, TSC1, MDGA2, TSC2, MECP2, UBE3A, WNT2, see also 20110023145 |
| autosomal dominant polycystic kidney disease (ADPKD) - (includes diseases such as von Hippel-Lindau disease and tubreous sclerosis complex disease) | kidney | liver | PKD1, PKD2 |
| Autosomal Recessive Polycystic Kidney Disease (ARPKD) | kidney | liver | PKDH1 |
| Ataxia-Telangiectasia (a.k.a Louis Bar syndrome) | Nervous system, immune system | various | ATM |
| B-Cell Non-Hodgkin Lymphoma | | | BCL7A, BCL7 |
| Bardet-Biedl syndrome | Eye, musculoskeletal system, kidney, reproductive organs | Liver, ear, gastrointestinal system, brain | ARL6, BBS1, BBS2, BBS4, BBS5, BBS7, BBS9, BBS10, BBS12, CEP290, INPP5E, LZTFL1, MKKS, MKS1, SDCCAG8, TRIM32, TTC8 |
| Bare Lymphocyte Syndrome | blood | | TAPBP, TPSN, TAP2, ABCB3, PSF2, RING11, MHC2TA, C2TA, RFX5, RFXAP, RFX5 |
| Barter's Syndrome (types I, II, III, IVA and B, and V) | kidney | | SLC12A1 (type I), KCNJ1 (type II), CLCNKB (type III), BSND (type IV A), or both the CLCNKA CLCNKB genes (type IV B), CASR (type V). |
| Becker muscular dystrophy | Muscle | | DMD, BMD, MYF6 |
| Best Disease (Vitelliform Macular Dystrophy type 2) | eye | | VMD2 |
| Bleeding Disorders | blood | | TBXA2R, P2RX1, P2X1 |
| Blue Cone Monochromacy | eye | | OPN1LW, OPN1MW, and LCR |
| Breast Cancer | Breast tissue | | BRCA1, BRCA2, COX-2 |
| Bruton's Disease (aka X-linked Agammglobulinemia) | Immune system, specifically B cells | | BTK |
| Cancers (e.g., lymphoma, chronic lymphocytic leukemia (CLL), B cell acute lymphocytic leukemia (B-ALL), acute lymphoblastic leukemia, acute myeloid leukemia, non-Hodgkin's lymphoma (NHL), diffuse large cell lymphoma (DLCL), multiple myeloma, renal cell carcinoma (RCC), neuroblastoma, colorectal cancer, breast cancer, ovarian | Various | | FAS, BID, CTLA4, PDCD1, CBLB, PTPN6, TRAC, TRBC, those described in WO2015048577 |

TABLE 11-continued

Exemplary Genetic and Other Diseases and Associated Genes

| Disease Name | Primary Tissues or System Affected | Additional Tissues/Systems Affected | Genes |
|---|---|---|---|
| cancer, melanoma, sarcoma, prostate cancer, lung cancer, esophageal cancer, hepatocellular carcinoma, pancreatic cancer, astrocytoma, mesothelioma, head and neck cancer, and medulloblastoma | | | |
| Cardiovascular Diseases | heart | Vascular system | IL1B, XDH, TP53, PTGS, MB, IL4, ANGPT1, ABCGu8, CTSK, PTGIR, KCNJ11, INS, CRP, PDGFRB, CCNA2, PDGFB, KCNJ5, KCNN3, CAPN10, ADRA2B, ABCG5, PRDX2, CPAN5, PARP14, MEX3C, ACE, RNF, IL6, TNF, STN, SERPINE1, ALB, ADIPOQ, APOB, APOE, LEP, MTHFR, APOA1, EDN1, NPPB, NOS3, PPARG, PLAT, PTGS2, CETP, AGTR1, HMGCR, IGF1, SELE, REN, PPARA, PON1, KNG1, CCL2, LPL, VWF, F2, ICAM1, TGFB, NPPA, IL10, EPO, SOD1, VCAM1, IFNG, LPA, MPO, ESR1, MAPK, HP, F3, CST3, COG2, MMP9, SERPINC1, F8, HMOX1, APOC3, IL8, PROL1, CBS, NOS2, TLR4, SELP, ABCA1, AGT, LDLR, GPT, VEGFA, NR3C2, IL18, NOS1, NR3C1, FGB, HGF, ILIA, AKT1, LIPC, HSPD1, MAPK14, SPP1, ITGB3, CAT, UTS2, THBD, F10, CP, TNFRSF11B, EGFR, MMP2, PLG, NPY, RHOD, MAPK8, MYC, FN1, CMA1, PLAU, GNB3, ADRB2, SOD2, F5, VDR, ALOX5, HLA-DRB1, PARP1, CD40LG, PON2, AGER, IRS1, PTGS1, ECE1, F7, IRMN, EPHX2, IGFBP1, MAPK10, FAS, ABCB1, JUN, IGFBP3, CD14, PDE5A, AGTR2, CD40, LCAT, CCR5, MMP1, TIMP1, ADM, DYT10, STAT3, MMP3, ELN, USF1, CFH, HSPA4, MMP12, MME, F2R, SELL, CTSB, ANXA5, ADRB1, CYBA, FGA, GGT1, LIPG, HIF1A, CXCR4, PROC, SCARB1, CD79A, PLTP, ADD1, FGG, SAA1, KCNH2, DPP4, NPR1, VTN, KIAA0101, FOS, TLR2, PPIG, IL1R1, AR, CYP1A1, SERPINA1, MTR, RBP4, APOA4, CDKN2A, FGF2, EDNRB, ITGA2, VLA-2, CABIN1, SHBG, HMGB1, HSP90B2P, CYP3A4, GJA1, CAV1, ESR2, LTA, GDF15, BDNF, CYP2D6, NGF, SP1, TGIF1, SRC, EGF, PIK3CG, HLA-A, KCNQ1, CNR1, FBN1, CHKA, BEST1, CTNNB1, IL2, CD36, PRKAB1, TPO, ALDH7A1, CX3CR1, TH, F9, CH1, TF, HFE, IL17A, PTEN, GSTM1, DMD, GATA4, F13A1, TTR, FABP4, PON3, APOC1, INSR, TNFRSF1B, HTR2A, CSF3, CYP2C9, TXN, CYP11B2, PTH, CSF2, KDR, PLA2G2A, THBS1, GCG, RHOA, ALDH2, TCF7L2, NFE2L2, NOTCH1, UGT1A1, IFNA1, PPARD, SIRT1, GNHR1, PAPPA, ARR3, NPPC, AHSP, PTK2, IL13, MTOR, ITGB2, GSTT1, IL6ST, CPB2, CYP1A2, HNF4A, SLC64A, PLA2G6, TNFSF11, SLC8A1, F2RL1, AKR1A1, ALDH9A1, BGLAP, MTTP, MTRR, SULT1A3, RAGE, C4B, P2RY12, RNLS, CREB1, |

TABLE 11-continued

Exemplary Genetic and Other Diseases and Associated Genes

| Disease Name | Primary Tissues or System Affected | Additional Tissues/Systems Affected | Genes |
|---|---|---|---|
| | | | POMC, RAC1, LMNA, CD59, SCM5A, CYP1B1, MIF, MMP13, TIMP2, CYP19A1, CUP21A2, PTPN22, MYH14, MBL2, SELPLG, AOC3, CTSL1, PCNA, IGF2, ITGB1, CAST, CXCL12, IGHE, KCNE1, TFRC, COL1A1, COL1A2, IL2RB, PLA2G10, ANGPT2, PROCR, NOX4, HAMP, PTPN11, SLCA1, IL2RA, CCL5, IRF1, CF:AR, CA:CA, EIF4E, GSTP1, JAK2, CYP3A5, HSPG2, CCL3, MYD88, VIP, SOAT1, ADRBK1, NR4A2, MMP8, NPR2, GCH1, EPRS, PPARGC1A, F12, PECAM1, CCL4, CERPINA34, CASR, FABP2, TTF2, PROS1, CTF1, SGCB, YME1L1, CAMP, ZC3H12A, AKR1B1, MMP7, AHR, CSF1, HDAC9, CTGF, KCNMA1, UGT1A, PRKCA, COMT, S100B, EGR1, PRL, IL15, DRD4, CAMK2G, SLC22A2, CCL11, PGF, THPO, GP6, TACR1, NTS, HNF1A, SST, KCDN1, LOC646627, TBXAS1, CUP2J2, TBXA2R, ADH1C, ALOX12, AHSG, BHMT, GJA4, SLC25A4, ACLY, ALOX5AP, NUMA1, CYP27B1, CYSLTR2, SOD3, LTC4S, UCN, GHRL, APOC2, CLEC4A, KBTBD10, TNC, TYMS, SHC1, LRP1, SOCS3, ADH1B, KLK3, HSD11B1, VKORC1, SERPINB2, TNS1, RNF19A, EPOR, ITGAM, PITX2, MAPK7, FCGR3A, LEEPR, ENG, GPX1, GOT2, HRH1, NR112, CRH, HTR1A, VDAC1, HPSE, SFTPD, TAP2, RMF123, PTK2Bm NTRK2, IL6R, ACHE, GLP1R, GHR, GSR, NQO1, NR5A1, GJB2, SLC9A1, MAOA, PCSK9, FCGR2A, SERPINF1, EDN3, UCP2, TFAP2A, C4BPA, SERPINF2, TYMP, ALPP, CXCR2, SLC3A3, ABCG2, ADA, JAK3, HSPA1A, FASN, FGF1, F11, ATP7A, CR1, GFPA, ROCK1, MECP2, MYLK, BCHE, LIPE, ADORA1, WRN, CXCR3, CD81, SMAD7, LAMC2, MAP3K5, CHGA, IAPP, RHO, ENPP1, PTHLH, NRG1, VEGFC, ENPEP, CEBPB, NAGLU,. F2RL3, CX3CL1, BDKRB1, ADAMTS13, ELANE, ENPP2, CISH, GAST, MYOC, ATP1A2, NF1, GJB1, MEF2A, VCL, BMPR2, TUBB, CDC42, KRT18, HSF1, MYB, PRKAA2, ROCK2, TFP1, PRKG1, BMP2, CTNND1, CTH, CTSS, VAV2, NPY2R, IGFBP2, CD28, GSTA1, PPIA, APOH, S100A8, IL11, ALOX15, FBLN1, NR1H3, SCD, GIP, CHGB, PRKCB, SRD5A1, HSD11B2, CALCRL, GALNT2, ANGPTL4, KCNN4, PIK3C2A, HBEGF, CYP7A1, HLA-DRB5, BNIP3, GCKR, S100A12, PADI4, HSPA14, CXCR1, H19, KRTAP19-3, IDDM2, RAC2, YRY1, CLOCK, NGFR, DBH, CHRNA4, CACNA1C, PRKAG2, CHAT, PTGDS, NR1H2, TEK, VEGFB, MEF2C, MAPKAPK2, TNFRSF11A, HSPA9, CYSLTR1, MATIA, OPRL1, IMPA1, CLCN2, DLD, PSMA6, PSMB8, CHI3L1, ALDH1B1, PARP2, STAR, LBP, |

TABLE 11-continued

Exemplary Genetic and Other Diseases and Associated Genes

| Disease Name | Primary Tissues or System Affected | Additional Tissues/Systems Affected | Genes |
|---|---|---|---|
| | | | ABCC6, RGS2, EFNB2, GJB6, APOA2, AMPD1, DYSF, FDFT1, EMD2, CCR6, GJB3, IL1RL1, ENTPD1, BBS4, CELSR2, F11R, RAPGEF3, HYAL1, ZNF259, ATOX1, ATF6, KHK, SAT1, GGH, TIMP4, SLC4A4, PDE2A, PDE3B, FADS1, FADS2, TMSB4X, TXNIP, LIMS1, RHOB, LY96, FOXO1, PNPLA2, TRH, GJC1, S:C17A5, FTO, GJD2, PRSC1, CASP12, GPBAR1, PXK, IL33, TRIB1, PBX4, NUPR1, 15-SEP, CILP2, TERC, GGT2, MTCO1, UOX, AVP, ANGPLT3 |
| Cataract | eye | | CRYAA, CRYA1, CRYBB2, CRYB2, PITX3, BFSP2, CP49, CP47, CRYAA, CRYA1, PAX6, AN2, MGDA, CRYBA1, CRYB1, CRYGC, CRYG3, CCL, LIM2, MP19, CRYGD, CRYG4, BFSP2, CP49, CP47, HSF4, CTM, HSF4, CTM, MIP, AQP0, CRYAB, CRYA2, CTPP2, CRYBB1, CRYGD, CRYG4, CRYBB2, CRYB2, CRYGC, CRYG3, CCL, CRYAA, CRYA1, GJA8, CX50, CAE1, GJA3, CX46, CZP3, CAE3, CCM1, CAM, KRIT1 |
| CDKL-5 Deficiencies or Mediated Diseases | Brain, CNS | | CDKL5 |
| Charcot-Marie-Tooth (CMT) disease (Types 1, 2, 3, 4,) | Nervous system | Muscles (dystrophy) | PMP22 (CMT1A and E), MPZ (CMT1B), LITAF (CMT1C), EGR2 (CMT1D), NEFL (CMT1F), GJB1 (CMT1X), MFN2 (CMT2A), KIF1B (CMT2A2B), RAB7A (CMT2B), TRPV4 (CMT2C), GARS (CMT2D), NEFL (CMT2E), GAPD1 (CMT2K), HSPB8 (CMT2L), DYNC1H1, CMT20), LRSAM1 (CMT2P), IGHMBP2 (CMT2S), MORC2 (CMT2Z), GDAP1 (CMT4A), MTMR2 or SBF2/MTMR13 (CMT4B), SH3TC2 (CMT4C), NDRG1 (CMT4D), PRX (CMT4F), FIG4 (CMT4J), NT-3 |
| Chédiak-Higashi Syndrome | Immune system | Skin, hair, eyes, neurons | LYST |
| Choroidermia | | | CHM, REP1, |
| Chorioretinal atrophy | eye | | PRDM13, RGR, TEAD1 |
| Chronic Granulomatous Disease | Immune system | | CYBA, CYBB, NCF1, NCF2, NCF4 |
| Chronic Mucocutaneous Candidiasis | Immune system | | AIRE, CARD9, CLEC7A IL12B, IL12B1, IL1F, IL17RA, IL17RC, RORC, STAT1, STAT3, TRAF31P2 |
| Cirrhosis | liver | | KRT18, KRT8, CIRH1A, NAIC, TEX292, KIAA1988 |
| Colon cancer (Familial adenomatous polyposis (FAP) and hereditary nonpolyposis colon cancer (HNPCC)) | Gastrointestinal | | FAP: APC HNPCC: MSH2, MLH1, PMS2, SH6, PMS1 |
| Combined Immunodeficiency | Immune System | | IL2RG, SCIDX1, SCIDX, IMD4); HIV-1 (CCL5, SCYA5, D17S136E, TCP228 |
| Cone(-rod) dystrophy | eye | | AIPL1, CRX, GUA1A, GUCY2D, PITPM3, PROM1, PRPH2, RIMS1, SEMA4A, ABCA4, ADAM9, ATF6, C21ORF2, C8ORF37, CACNA2D4, CDHR1, CERKL, CNGA3, CNGB3, CNNM4, CNAT2, IFT81, KCNV2, PDE6C, PDE6H, POC1B, RAX2, RDH5, RPGRIP1, TTLL5, RetCG1, GUCY2E |
| Congenital Stationary Night Blindness | eye | | CABP4, CACNA1F, CACNA2D4, GNAT1, CPR179, GRK1, GRM6, LRIT3, NYX, PDE6B, RDH5, RHO, RLBP1, RPE65, SAG, SLC24A1, TRPM1, |

TABLE 11-continued

Exemplary Genetic and Other Diseases and Associated Genes

| Disease Name | Primary Tissues or System Affected | Additional Tissues/Systems Affected | Genes |
|---|---|---|---|
| Congenital Fructose Intolerance | Metabolism | | ALDOB |
| Cori's Disease (Glycogen Storage Disease Type III) | Various- wherever glycogen accumulates, particularly liver, heart, skeletal muscle | | AGL |
| Corneal clouding and dystrophy | eye | | APOA1, TGFBI, CSD2, CDGG1, CSD, BIGH3, CDG2, TACSTD2, TROP2, M1S1, VSX1, RINX, PPCD, PPD, KTCN, COL8A2, FECD, PPCD2, PIP5K3, CFD |
| Cornea plana congenital | | | KERA, CNA2 |
| Cri du chat Syndrome, also known as 5p syndrome and cat cry syndrome | | | Deletions involving only band 5p15.2 to the entire short arm of chromosome 5, e.g. CTNND2, TERT, |
| Cystic Fibrosis (CF) | Lungs and respiratory system | Pancreas, liver, digestive system, reproductive system, exocrine, glands, | CTFR, ABCC7, CF, MRP7, SCNN1A, those described in WO2015157070 |
| Diabetic nephropathy | kidney | | Gremlin, 12/15- lipoxygenase, TIM44, |
| Dent Disease (Types 1 and 2) | Kidney | | Type 1: CLCN5, Type 2: ORCL |
| Dentatorubro-Pallidoluysian Atrophy (DRPLA) (aka Haw River and Naito-Oyanagi Disease) | CNS, brain, muscle | | Atrophin-1 and Atn1 |
| Down Syndrome | various | | Chromosome 21 trisomy |
| Drug Addiction | Brain | | Prkce; Drd2; Drd4; ABAT; GRIA2; Grm5; Grin1; Htr1b; Grin2a; Drd3; Pdyn; Gria1 |
| Duane syndrome (Types 1, 2, and 3, including subgroups A, B and C). Other names for this condition include: Duane's Retraction Syndrome (or DR syndrome), Eye Retraction Syndrome, Retraction Syndrome, Congenital retraction syndrome and Stilling-Turk-Duane Syndrome | eye | | CHN1, indels on chromosomes 4 and 8 |
| Duchenne muscular dystrophy (DMD) | muscle | Cardiovascular, respiratory | DMD, BMD, dystrophin gene, intron flanking exon 51 of DMD gene, exon 51 mutations in DMD gene, see also WO2013163628 and US Pat. Pub. 20130145487 |
| Edward's Syndrome (Trisomy 18) | | | Complete or partial trisomy of chromosome 18 |
| Ehlers-Danlos Syndrome (Types I-VI) | Various depending on type: including musculoskeletal, eye, vasculature, immune, and skin | | COL5A1, COL5A2, COL1A1, COL3A1, TNXB, PLOD1, COL1A2, FKBP14 and ADAMTS2 |
| Emery-Dreifuss muscular dystrophy | muscle | | LMNA, LMN1, EMD2, FPLD, CMD1A, HGPS, LGMD1B, LMNA, LMN1, EMD2, FPLD, CMD1A |
| Enhanced S-Cone Syndrome | eye | | NR2E3, NRL |
| Fabry's Disease | Various - including skin, eyes, and gastrointestinal system, kidney, heart, brain, nervous system | | GLA |
| Facioscapulohumeral muscular dystrophy | muscles | | FSHMD1A, FSHD1A, FRG1, |
| Factor H and Factor H-like 1 | blood | | HF1, CFH, HUS |
| Factor V Leiden thrombophilia and Factor V deficiency | blood | | Factor V (F5) |

TABLE 11-continued

Exemplary Genetic and Other Diseases and Associated Genes

| Disease Name | Primary Tissues or System Affected | Additional Tissues/Systems Affected | Genes |
|---|---|---|---|
| Factor V and Factor VII deficiency | blood | | MCFD2 |
| Factor VII deficiency | blood | | F7 |
| Factor X deficiency | blood | | F10 |
| Factor XI deficiency | blood | | F11 |
| Factor XII deficiency | blood | | F12, HAF |
| Factor XIIIA deficiency | blood | | F13A1, F13A |
| Factor XIIIB deficiency | blood | | F13B |
| Familial Hypercholestereolemia | Cardiovascular system | | APOB, LDLR, PCSK9 |
| Familial Mediterranean Fever (FMF) also called recurrent polyserositis or familial paroxysmal polyserositis | Various-organs/tissues with serous or synovial membranes, skin, joints | Heart, kidney, brain/CNS, reproductive organs | MEFV |
| Fanconi Anemia | Various - blood (anemia), immune system, cognitive, kidneys, eyes, musculoskeletal | | FANCA, FACA, FA1, FA, FAA, FAAP95, FAAP90, FLJ34064, FANCC, FANCG, RAD51, BRCA1, BRCA2, BRIP1, BACH1, FANCJ, FANCB, FANCD1, FANCD2, FANCD, FAD, FANCE, FACE, FANCF, FANCI, ERCC4, FANCL, FANCM, PALB2, RAD51C, SLX4, UBE2T, FANCB, XRCC9, PHF9, KIAA1596 |
| Fanconi Syndrome Types I (Childhood onset) and II (Adult Onset) | kidneys | | FRTS1, GATM |
| Fragile X syndrome and related disorders | brain | | FMR1, FMR2; FXR1; FXR2; mGLUR5 |
| Fragile XE Mental Retardation (aka Martin Bell syndrome) | Brain, nervous system | | FMR1 |
| Friedreich Ataxia (FRDA) | Brain, nervous system | heart | FXN/X25 |
| Fuchs endothelial corneal dystrophy | Eye | | TCF4; COL8A2 |
| Galactosemia | Carbohydrate metabolism disorder | Various-where galactose accumulates - liver, brain, eyes | GALT, GALK1, and GALE |
| Gastrointestinal Epithelial Cancer, GI cancer | | | CISH |
| Gaucher Disease (Types 1, 2, and 3, as well as other unusual forms that may not fit into these types) | Fat metabolism disorder | Various-liver, spleen, blood, CNS, skeletal system | GBA |
| Griscelli syndrome | | | |
| Glaucoma | eye | | MYOC, TIGR, GLC1A, JOAG, GPOA, OPTN, GLC1E, FIP2, HYPL, NRP, CYP1B1, GLC3A, OPA1, NTG, NPG, CYP1B1, GLC3A, those described in WO2015153780 |
| Glomerulo sclerosis | kidney | | CC chemokine ligand 2 |
| Glycogen Storage Diseases Types I-VI -See also Cori's Disease, Pompe's Disease, McArdle's disease, Hers Disease, and Von Gierke's disease | Metabolism Diseases | | SLC2A2, GLUT2, G6PC, G6PT, G6PT1, GAA, LAMP2, LAMPB, AGL, GDE, GBE1, GYS2, PYGL, PFKM, see also Cori's Disease, Pompe's Disease, McArdle's disease, Hers Disease, and Von Gierke's disease |
| RBC Glycolytic enzyme deficiency | blood | | any mutations in a gene for an enzyme in the glycolysis pathway including mutations in genes for hexokinases I and II, glucokinase, phosphoglucose isomerase, phosphofructokinase, aldolase Bm triosephosphate isomerease, glyceraldehydee-3-phosphate dehydrogenase, phosphoglycerokinase, phosphoglycerate mutase, enolase I, pyruvate kinase |

TABLE 11-continued

Exemplary Genetic and Other Diseases and Associated Genes

| Disease Name | Primary Tissues or System Affected | Additional Tissues/Systems Affected | Genes |
|---|---|---|---|
| Hartnup's disease | Malabsorption disease | Various- brain, gastrointestinal, skin, | SLC6A19 |
| Hearing Loss | ear | | NOX3, Hes5, BDNF, |
| Hemochromatosis (HH) | Iron absorption regulation disease | Various- wherever iron accumulates, liver, heart, pancreas, joints, pituitary gland | HFE and H63D |
| Hemophagocytic lymphohistiocytosis disorders | blood | | PRF1, HPLH2, UNC13D, MUNC13-4, HPLH3, HLH3, FHL3 |
| Hemorrhagic disorders | blood | | PI, ATT, F5 |
| Hers disease (Glycogen storage disease Type VI) | liver | muscle | PYGL |
| Hereditary angioedema (HAE) | | | kalikrein B1 |
| Hereditary Hemorrhagic Telangiectasia (Osler-Weber-Rendu Syndrome) | Skin and mucous membranes | | ACVRL1, ENG and SMAD4 |
| Hereditary Spherocytosis | blood | | NK1, EPB42, SLC4A1, SPTA1, and SPTB |
| Hereditary Persistence of Fetal Hemoglobin | blood | | HBG1, HBG2, BCL11A, promoter region of HBG 1 and/or 2 (in the CCAAT box) |
| Hemophilia (hemophilia A (Classic) a B (aka Christmas disease) and C) | blood | | A: FVIII, F8C, HEMA B: FVIX, HEMB, FIX C: F9, F11 |
| Hepatic adenoma | liver | | TCF1, HNF1A, MODY3 |
| Hepatic failure, early onset, and neurologic disorder | liver | | SCOD1, SCO1 |
| Hepatic lipase deficiency | liver | | LIPC |
| Hepatoblastoma, cancer and carcinomas | liver | | CTNNB1, PDGFRL, PDGRL, PRLTS, AXIN1, AXIN, CTNNB1, TP53, P53, LFS1, IGF2R, MPRI, MET, CASP8, MCH5 |
| Hermansky-Pudlak syndrome | Skin, eyes, blood, lung, kidneys, intestine | | HPS1, HPS3, HPS4, HPS5, HPS6, HPS7, DTNBP1, BLOC1, BLOC1S2, BLOC3 |
| HIV susceptibility or infection | Immune system | | IL10, CSIF, CMKBR2, CCR2, CMKBR5, CCCKR5 (CCR5), those in WO2015148670A1 |
| Holoprosencephaly (HPE) (Alobar, Semilobar, and Lobar) | brain | | ACVRL1, ENG, SMAD4 |
| Homocystinuria | Metabolic disease | Various- connective tissue, muscles, CNS, cardiovascular system | CBS, MTHFR, MTR, MTRR, and MMADHC |
| HPV | | | HPV16 and HPV18 E6/E7 |
| HSV1, HSV2, and related keratitis | eye | | HSV1 genes (immediate early and late HSV-1 genes (UL1, 1.5, 5, 6, 8, 9, 12, 15, 16, 18, 19, 22, 23, 26, 26.5, 27, 28, 29, 30, 31, 32, 33, 34, 35, 36, 37, 38, 42, 48, 49.5, 50, 52, 54, S6, RL2, RS1, those described in WO2015153789, WO2015153791 |
| Hunter's Syndrome (aka Mucopolysaccharidosis type II) | Lysosomal storage disease | Various- liver, spleen, eye, joint, heart, brain, skeletal | IDS |
| Huntington's disease (HD) and HD-like disorders | Brain, nervous system | | HD, HTT, IT15, PRNP, PRIP, JPH3, JP3, HDL2, TBP, SCA17, PRKCE; IGF1; EP300; RCOR1; PRKCZ; HDAC4; and TGM2, and those described in WO2013130824, WO2015089354 |
| Hurler's Syndrome (aka mucopolysaccharidosis type I H, MPS IH) | Lysosomal storage disease | Various- liver, spleen, eye, joint, heart, brain, skeletal | IDUA, α-L-iduronidase |

TABLE 11-continued

Exemplary Genetic and Other Diseases and Associated Genes

| Disease Name | Primary Tissues or System Affected | Additional Tissues/Systems Affected | Genes |
|---|---|---|---|
| Hurler-Scheie syndrome (aka mucopolysaccharidosis type I H-S, MPS I H-S) | Lysosomal storage disease | Various- liver, spleen, eye, joint, heart, brain, skeletal | IDUA, α-L-iduronidase |
| hyaluronidase deficiency (aka MPS IX) | Soft and connective tissues | | HYAL1 |
| Hyper IgM syndrome | Immune system | | CD40L |
| Hyper- tension caused renal damage | kidney | | Mineral corticoid receptor |
| Immunodeficiencies | Immune System | | CD3E, CD3G, AICDA, AID, HIGM2, TNFRSF5, CD40, UNG, DGU, HIGM4, TNFSF5, CD40LG, HIGM1, IGM, FOXP3, IPEX, AIID, XPID, PIDX, TNFRSF14B, TACI |
| Inborn errors of metabolism: including urea cycle disorders, organic acidemias), fatty acid oxidation defects, amino acidopathies, carbohydrate disorders, mitochondrial disorders | Metabolism diseases, liver | Various organs and cells | See also: Carbohydrate metabolism disorders (e.g. galactosemia), Amino acid Metabolism disorders (e.g. phenylketonuria), Fatty acid metabolism (e.g. MCAD deficiency), Urea Cycle disorders (e.g. Citrullinemia), Organic acidemias (e.g. Maple Syrup Urine disease), Mitochondrial disorders (e.g. MELAS), peroxisomal disorders (e.g. Zellweger syndrome) |
| Inflammation | Various | | IL-10; IL-1 (IL-1a; IL-1b); IL-13; IL-17 (IL-17a (CTLA8); IL-17b; IL-17c; IL-17d; IL-17f); II-23; Cx3cr1; ptpn22; TNFa; NOD2/CARD15 for IBD; IL-6; IL-12 (IL-12a; IL-12b); CTLA4; Cx3cl1 |
| Inflammatory Bowel Diseases (e.g. Ulcerative Colitis and Chron's Disease) | Gastrointestinal | Joints, skin | NOD2, IRGM, LRRK2, ATG5, ATG16L1, IRGM, GATM, ECM1, CDH1, LAMB1, HNF4A, GNA12, IL10, CARD9/15. CCR6, IL2RA, MST1, TNFSF15, REL, STAT3, IL23R, IL12B, FUT2 |
| Interstitial renal fibrosis | kidney | | TGF-β type II receptor |
| Job's Syndrome (aka Hyper IgE Syndrome) | Immune System | | STAT3, DOCK8 |
| Juvenile Retinoschisis | eye | | RS1, XLRS1 |
| Kabuki Syndrome 1 | | | MLL4, KMT2D |
| Kennedy Disease (aka Spinobulbar Muscular Atrophy) | Muscles, brain, nervous system | | SBMA/SMAX1/AR |
| Klinefelter syndrome | Various- particularly those involved in development of male characteristics | | Extra X chromosome in males |
| Lafora Disease | Brain, CNS | | EMP2A and EMP2B |
| Leber Congenital Amaurosis | eye | | CRB1, RP12, CORD2, CRD, CRX, IMPDH1, OTX2, AIPL1, CABP4, CCT2, CEP290, CLUAP1, CRB1, CRX, DTHD1, GDF6, GUCY2D, IFT140, IQCB1, KCNJ13, LCA5, LRAT, NMNAT1, PRPH2, RD3, RDH12, RPE65, RP20, RPGRIP1, SPATA7, TULP1, LCA1, LCA4, GUC2D, CORD6, LCA3, |
| Lesch-Nyhan Syndrome | Metabolism disease | Various - joints, cognitive, brain, nervous system | HPRT1 |
| Leukocyte deficiencies and disorders | blood | | ITGB2, CD18, LCAMB, LAD, EIF2B1, EIF2BA, EIF2B2, EIF2B3, EIF2B5, LVWM, CACH, CLE, EIF2B4 |
| Leukemia | Blood | | TAL1, TCL5, SCL, TAL2, FLT3, NBS1, NBS, ZNFN1A1, IK1, LYF1, HOXD4, HOX4B, BCR, CML, PHL, ALL, ARNT, KRAS2, RASK2, GMPS, AF10, ARHGEF12, LARG, |

TABLE 11-continued

Exemplary Genetic and Other Diseases and Associated Genes

| Disease Name | Primary Tissues or System Affected | Additional Tissues/Systems Affected | Genes |
|---|---|---|---|
| | | | KIAA0382, CALM, CLTH, CEBPA, CEBP, CHIC2, BTL, FLT3, KIT, PBT, LPP, NPM1, NUP214, D9S46E, CAN, CAIN, RUNX1, CBFA2, AML1, WHSC1L1, NSD3, FLT3, AF1Q, NPM1, NUMA1, ZNF145, PLZF, PML, MYL, STAT5B, AF10, CALM, CLTH, ARL11, ARLTS1, P2RX7, P2X7, BCR, CML, PHL, ALL, GRAF, NF1, VRNF, WSS, NFNS, PTPN11, PTP2C, SHP2, NS1, BCL2, CCND1, PRAD1, BCL1, TCRA, GATA1, GF1, ERYF1, NFE1, ABL1, NQO1, DIA4, NMOR1, NUP214, D9S46E, CAN, CAIN |
| Limb-girdle muscular dystrophy diseases | muscle | | LGMD |
| Lowe syndrome | brain, eyes, kidneys | | OCRL |
| Lupus glomerulo- nephritis | kidney | | MAPK1 |
| Machado- Joseph's Disease (also known as Spinocerebellar ataxia Type 3) | Brain, CNS, muscle | | ATX3 |
| Macular degeneration | eye | | ABC4, CBC1, CHM1, APOE, C1QTNF5, C2, C3, CCL2, CCR2, CD36, CFB, CFH, CFHR1, CFHR3, CNGB3, CP, CRP, CST3, CTSD, CX3CR1, ELOVL4, ERCC6, FBLN5, FBLN6, FSCN2, HMCN1, HIRAI, IL6, IL8, PLEKHA1, PROM1, PRPH2, RPGR, SERPING1, TCOF1, TIMP3, TLR3 |
| Macular Dystrophy | eye | | BEST1, C1QTNF5, CTNNA1, EFEMP1, ELOVL4, FSCN2, GUCA1B, HMCN1, IMPG1, OTX2, PRDM13, PROM1, PRPH2, RP1L1, TIMP3, ABCA4, CFH, DRAM2, IMG1, MFSD8, ADMD, STGD2, STGD3, RDS, RP7, PRPH, AVMD, AOFMD, VMD2 |
| Malattia Leventinesse | eye | | EFEMP1, FBLN3 |
| Maple Syrup Urine Disease | Metabolism disease | | BCKDHA, BCKDHB, and DBT |
| Marfan syndrome | Connective tissue | Musculoskeletal | FBN1 |
| Maroteaux-Lamy Syndrome (aka MPS VI) | Musculoskeletal system, nervous system | Liver, spleen | ARSB |
| McArdle's Disease (Glycogen Storage Disease Type V) | Glycogen storage disease | muscle | PYGM |
| Medullary cystic kidney disease | kidney | | UMOD, HNFJ, FJHN, MCKD2, ADMCKD2 |
| Metachromatic leukodystrophy | Lysosomal storage disease | Nervous system | ARSA |
| Methylmalonic acidemia (MMA) | Metabolism disease | | MMAA, MMAB, MUT, MMACHC, MMADHC, LMBRD1 |
| Morquio Syndrome (aka MPS IV A and B) | Connective tissue, skin, bone, eyes | heart | GALNS |
| Mucopolysaccharidosis diseases (Types I H/S, I H, II, III A B and C, I S, IVA and B, IX, VII, and VI) | Lysosomal storage disease - affects various organs/tissues | | See also Hurler/Scheie syndrome, Hurler disease, Sanfillipo syndrome, Scheie syndrome, Morquio syndrome, hyaluronidase deficiency, Sly syndrome, and Maroteaux-Lamy syndrome |
| Muscular Atrophy | muscle | | VAPB, VAPC, ALS8, SMN1, SMA1, SMA2, SMA3, SMA4, BSCL2, SPG17, GARS, SMAD1, CMT2D, HEXB, IGHMBP2, SMUBP2, CATF1, SMARD1 |
| Muscular dystrophy | muscle | | FKRP, MDC1C, LGMD2I, LAMA2, LAMM, LARGE, KIAA0609, MDC1D, FCMD, TTID, MYOT, CAPN3, CANP3, DYSF, LGMD2B, |

TABLE 11-continued

Exemplary Genetic and Other Diseases and Associated Genes

| Disease Name | Primary Tissues or System Affected | Additional Tissues/Systems Affected | Genes |
|---|---|---|---|
| Myotonic dystrophy (Type 1 and Type 2) | Muscles | Eyes, heart, endocrine | SGCG, LGMD2C, DMDA1, SCG3, SGCA, ADL, DAG2, LGMD2D, DMDA2, SGCB, LGMD2E, SGCD, SGD, LGMD2F, CMD1L, TCAP, LGMD2G, CMD1N, TRIM32, HT2A, LGMD2H, FKRP, MDC1C, LGMD2I, TTN, CMD1G, TMD, LGMD2J, POMT1, CAV3, LGMD1C, SEPN1, SELN, RSMD1, PLEC1, PLTN, EBS1 CNBP (Type 2) and DMPK (Type 1) |
| Neoplasia | | | PTEN; ATM; ATR; EGFR; ERBB2; ERBB3; ERBB4; Notch1; Notch2; Notch3; Notch4; AKT; AKT2; AKT3; HIF; HIF1a; HIF3a; Met; HRG; Bcl2; PPAR alpha; PPAR gamma; WT1 (Wilms Tumor); FGF Receptor Family members (5 members: 1, 2, 3, 4, 5); CDKN2a; APC; RB (retinoblastoma); MEN1; VHL; BRCA1; BRCA2; AR (Androgen Receptor); TSG101; IGF; IGF Receptor; Igf1 (4 variants); Igf2 (3 variants); Igf 1 Receptor; Igf 2 Receptor; Bax; Bcl2; caspases family (9 members: 1, 2, 3, 4, 6, 7, 8, 9, 12); Kras; Apc |
| Neurofibromatosis (NF) (NF1, formerly Recklinghausen's NF, and NF2) | brain, spinal cord, nerves, and skin | | NF1, NF2 |
| Niemann-Pick Lipidosis (Types A, B, and C) | Lysosomal Storage Disease | Various- where sphingomyelin accumulates, particularly spleen, liver, blood, CNS | Types A and B: SMPD1; Type C: NPC1 or NPC2 |
| Noonan Syndrome | Various - musculoskeletal, heart, eyes, reproductive organs, blood | | PTPN11, SOS1, RAF1 and KRAS |
| Norrie Disease or X-linked Familial Exudative Vitreoretinopathy | eye | | NDP |
| North Carolina Macular Dystrophy | eye | | MCDR1 |
| Osteogenesis imperfecta (OI) (Types I, II, III, IV, V, VI, VII) | bones, musculoskeletal | | COL1A1, COL1A2, CRTAP, P3H |
| Osteopetrosis | bones | | LRP5, BMND1, LRP7, LR3, OPPG, VBCH2, CLCN7, CLC7, OPTA2, OSTM1, GL, TCIRG1, TIRC7, OC116, OPTB1 |
| Patau's Syndrome (Trisomy 13) | Brain, heart, skeletal system | | Additional copy of chromosome 13 |
| Parkinson's disease (PD) | Brain, nervous system | | SNCA (PARK1), UCHL1 (PARK 5), and LRRK2 (PARK8), (PARK3), PARK2, PARK4, PARK7 (PARK7), PINK1 (PARK6); x-Synuclein, DJ-1, Parkin, NR4A2, NURR1, NOT, TINUR, SNCAIP, TBP, SCA17, NCAP, PRKN, PDJ, DBH, NDUFV2 |
| Pattern Dystrophy of the RPE | eye | | RDS/peripherin |
| Phenylketonuria (PKU) | Metabolism disorder | Various due to build-up of phenylalanine, phenyl ketones in tissues and CNS | PAH, PKU1, QDPR, DHPR, PTS |

TABLE 11-continued

Exemplary Genetic and Other Diseases and Associated Genes

| Disease Name | Primary Tissues or System Affected | Additional Tissues/Systems Affected | Genes |
|---|---|---|---|
| Polycystic kidney and hepatic disease | Kidney, liver | | FCYT, PKHD1, ARPKD, PKD1, PKD2, PKD4, PKDTS, PRKCSH, G19P1, PCLD, SEC63 |
| Pompe's Disease | Glycogen storage disease | Various - heart, liver, spleen | GAA |
| Porphyria (actually refers to a group of different diseases all having a specific heme production process abnormality) | Various- wherever heme precursors accumulate | | ALAD, ALAS2, CPOX, FECH, HMBS, PPOX, UROD, or UROS |
| posterior polymorphous corneal dystrophy | eyes | | TCF4; COL8A2 |
| Primary Hyperoxaluria (e.g. type 1) | Various - eyes, heart, kidneys, skeletal system | | LDHA (lactate dehydrogenase A) and hydroxyacid oxidase 1 (HAO1) |
| Primary Open Angle Glaucoma (POAG) | eyes | | MYOC |
| Primary sclerosing cholangitis | Liver, gallbladder | | TCF4; COL8A2 |
| Progeria (also called Hutchinson-Gilford progeria syndrome) | All | | LMNA |
| Prader-Willi Syndrome | Musculoskeletal system, brain, reproductive and endocrine system | | Deletion of region of short arm of chromosome 15, including UBE3A |
| Prostate Cancer | prostate | | HOXB13, MSMB, GPRC6A, TP53 |
| Pyruvate Dehydrogenase Deficiency | Brain, nervous system | | PDHA1 |
| Kidney/Renal carcinoma | kidney | | RLIP76, VEGF |
| Rett Syndrome | Brain | | MECP2, RTT, PPMX, MRX16, MRX79, CDKL5, STK9, MECP2, RTT, PPMX, MRX16, MRX79, x-Synuclein, DJ-1 |
| Retinitis pigmentosa (RP) | eye | | ADIPOR1, ABCA4, AGBL5, ARHGEF18, ARL2BP, ARL3, ARL6, BEST1, BBS1, BBS2, C2ORF71, C8ORF37, CA4, CERKL, CLRN1, CNGA1, CMGB1, CRB1, CRX, CYP4V2, DHDDS, DHX38, EMC1, EYS, FAM161A, FSCN2, GPR125, GUCA1B, HK1, HPRPF3, HGSNAT, IDH3B, IMPDH1, IMPG2, IFT140, IFT172, KLHL7, KIAA1549, KIZ, LRAT, MAK, MERTK, MVK, NEK2, NUROD1, NR2E3, NRL, OFD1, PDE6A, PDE6B, PDE6G, POMGNT1, PRCD, PROM1, PRPF3, PRPF4, PRPF6, PRPF8, PRPF31, PRPH2, RPB3, RDH12, REEP6, RP39, RGR, RHO, RLBP1, ROM1, RP1, RP1L1, RPY, RP2, RP9, RPE65, RPGR, SAMD11, SAG, SEMA4A, SLC7A14, SNRNP200, SPP2, SPATA7, TRNT1, TOPORS, TTC8, TULP1, USH2A, ZFN408, ZNF513, see also 20120204282 |
| Scheie syndrome (also known as mucopolysaccharidosis type I S(MPS I-S)) | Various- liver, spleen, eye, joint, heart, brain, skeletal | | IDUA, α-L-iduronidase |
| Schizophrenia | Brain | | Neuregulin1 (Nrg1); Erb4 (receptor for Neuregulin); Complexin1 (Cplx1); Tph1 Tryptophan hydroxylase; Tph2 Tryptophan hydroxylase 2; Neurexin 1; GSK3; GSK3a; GSK3b; 5-HTT (Slc6a4); COMT; DRD (Drd1a); SLC6A3; DAOA; DTNBP1; Dao (Dao1); TCF4; COL8A2 |
| Secretase Related Disorders | Various | | APH-1 (alpha and beta); PSEN1; NCSTN; PEN-2; Nos1, Parp1, Nat1, Nat2, CTSB, APP, APH1B, PSEN2, PSENEN, BACE1, ITM2B, CTSD, |

TABLE 11-continued

Exemplary Genetic and Other Diseases and Associated Genes

| Disease Name | Primary Tissues or System Affected | Additional Tissues/Systems Affected | Genes |
|---|---|---|---|
| | | | NOTCH1, TNF, INS, DYT10, ADAM17, APOE, ACE, STN, TP53, IL6, NGFR, IL1B, ACHE, CTNNB1, IGF1, IFNG, NRG1, CASP3, MAPK1, CDH1, APBB1, HMGCR, CREB1, PTGS2, HES1, CAT, TGFB1, ENO2, ERBB4, TRAPPC10, MAOB, NGF, MMP12, JAG1, CD40LG, PPARG, FGF2, LRP1, NOTCH4, MAPK8, PREP, NOTCH3, PRNP, CTSG, EGF, REN, CD44, SELP, GHR, ADCYAP1, INSR, GFAP, MMP3, MAPK10, SP1, MYC, CTSE, PPARA, JUN, TIMP1, IL5, IL1A, MMP9, HTR4, HSPG2, KRAS, CYCS, SMG1, IL1R1, PROK1, MAPK3, NTRK1, IL13, MME, TKT, CXCR2, CHRM1, ATXN1, PAWR, NOTCJ2, M6PR, CYP46A1, CSNK1D, MAPK14, PRG2, PRKCA, L1 CAM, CD40, NR1I2, JAG2, CTNND1, CMA1, SORT1, DLK1, THEM4, JUP, CD46, CCL11, CAV3, RNASE3, HSPA8, CASP9, CYP3A4, CCR3, TFAP2A, SCP2, CDK4, JOF1A, TCF7L2, B3GALTL, MDM2, RELA, CASP7, IDE, FANP4, CASK, ADCYAP1R1, ATF4, PDGFA, C21ORF33, SCG5, RMF123, NKFB1, ERBB2, CAV1, MMP7, TGFA, RXRA, STX1A, PSMC4, P2RY2, TNFRSF21, DLG1, NUMBL, SPN, PLSCR1, UBQLN2, UBQLN1, PCSK7, SPON1, SILV, QPCT, HESS, GCC1 |
| Selective IgA Deficiency | Immune system | | Type 1: MSH5; Type 2: TNFRSF13B |
| Severe Combined Immunodeficiency (SCID) and SCID-XI, and ADA-SCID | Immune system | | JAK3, JAKL, DCLRE1C, ARTEMIS, SCIDA, RAG1, RAG2, ADA, PTPRC, CD45, LCA, IL7R, CD3D, T3D, IL2RG, SCIDX1, SCIDX, IMD4, those identified in U.S. Pat. App. Pub. 20110225664, 20110091441, 20100229252, 20090271881 and 20090222937; |
| Sickle cell disease | blood | | HBB, BCL11A, BCL11Ae, cis-regulatory elements of the B-globin locus, HBG 1/2 promoter, HBG distal CCAAT box region between −92 and −130 of the HBG Transcription Start Site, those described in WO2015148863, WO 2013/126794, US Pat. Pub. 20110182867 |
| Sly Syndrome (aka MPS VII) | | | GUSB |
| Spinocerebellar Ataxias (SCA types 1, 2, 3, 6, 7, 8, 12 and 17) | | | ATXN1, ATXN2, ATX3 |
| Sorsby Fundus Dystrophy | eye | | TIMP3 |
| Stargardt disease | eye | | ABCR, ELOVL4, ABCA4, PROM1 |
| Tay-Sachs Disease | Lysosomal Storage disease | Various - CNS, brain, eye | HEX-A |
| Thalassemia (Alpha, Beta, Delta) | blood | | HBA1, HBA2 (Alpha), HBB (Beta), HBB and HBD (delta), LCRB, BCL11A, BCL11Ae, cis-regulatory elements of the B-globin locus, HBG 1/2 promoter, those described in WO2015148860, US Pat. Pub. 20110182867, 2015/148860 |
| Thymic Aplasia (DiGeorge Syndrome; 22q11.2 deletion syndrome) | Immune system, thymus | | deletion of 30 to 40 genes in the middle of chromosome 22 at a location known as 22q11.2, including TBX1, DGCR8 |
| Transthyretin amyloidosis (ATTR) | liver | | TTR (transthyretin) |
| trimethylaminuria | Metabolism disease | | FMO3 |

TABLE 11-continued

Exemplary Genetic and Other Diseases and Associated Genes

| Disease Name | Primary Tissues or System Affected | Additional Tissues/Systems Affected | Genes |
|---|---|---|---|
| Trinucleotide Repeat Disorders (generally) | Various | | HTT; SBMA/SMAX1/AR; FXN/X25 ATX3; ATXN1; ATXN2; DMPK; Atrophin-1 and Atn1 (DRPLA Dx); CBP (Creb-BP - global instability); VLDLR; Atxn7; Atxn10; FEN1, TNRC6A, PABPN1, JPH3, MED15, ATXN1, ATXN3, TBP, CACNA1A, ATXN80S, PPP2R2B, ATXN7, TNRC6B, TNRC6C, CELF3, MAB21L1, MSH2, TMEM185A, SIX5, CNPY3, RAXE, GNB2, RPL14, ATXN8, ISR, TTR, EP400, GIGYF2, OGG1, STC1, CNDP1, C10ORF2, MAML3, DKC1, PAXIP1, CASK, MAPT, SP1, POLG, AFF2, THBS1, TP53, ESR1, CGGBP1, ABT1, KLK3, PRNP, JUN, KCNN3, BAX, FRAXA, KBTBD10, MBNL1, RAD51, NCOA3, ERDA1, TSC1, COMP, GGLC, RRAD, MSH3, DRD2, CD44, CTCF, CCND1, CLSPN, MEF2A, PTPRU, GAPDH, TRIM22, WT1, AHR, GPX1, TPMT, NDP, ARX, TYR, EGR1, UNG, NUMBL, FABP2, EN2, CRYGC, SRP14, CRYGB, PDCD1, HOXA1, ATXN2L, PMS2, GLA, CBL, FTH1, IL12RB2, OTX2, HOXA5, POLG2, DLX2, AHRR, MANF, RMEM158, see also 20110016540 |
| Turner's Syndrome (XO) | Various - reproductive organs, and sex characteristics, vasculature | | Monosomy X |
| Tuberous Sclerosis | CNS, heart, kidneys | | TSC1, TSC2 |
| Usher syndrome (Types I, II, and III) | Ears, eyes | | ABHD12, CDH23, CIB2, CLRN1, DFNB31, GPR98, HARS, MYO7A, PCDH15, USH1C, USH1G, USH2A, USH11A, those described in WO2015134812A1 |
| Velocardiofacial syndrome (aka 22q11.2 deletion syndrome, DiGeorge syndrome, conotruncal anomaly face syndrome (CTAF), autosomal dominant Opitz G/BB syndrome or Cayler cardiofacial syndrome) | Various - skeletal, heart, kidney, immune system, brain | | Many genes are deleted, COM, TBX1, and other are associated with symptoms |
| Von Gierke's Disease (Glycogen Storage Disease type I) | Glycogen Storage disease | Various - liver, kidney | G6PC and SLC37A4 |
| Von Hippel-Lindau Syndrome | Various - cell growth regulation disorder | CNS, Kidney, Eye, visceral organs | VHL |
| Von Willebrand Disease (Types I, II and III) | blood | | VWF |
| Wilson Disease | Various - Copper Storage Disease | Liver, brains, eyes, other tissues where copper builds up | ATP7B |
| Wiskott-Aldrich Syndrome | Immune System | | WAS |
| Xeroderma Pigmentosum | Skin | Nervous system | POLH |
| XXX Syndrome | Endocrine, brain | | X chromosome trisomy |

In some embodiments, the CRISPR-Cas systems or components thereof can be used treat or prevent a disease in a subject by modifying one or more genes associated with one or more cellular functions, such as any one or more of those in Table 12. In some embodiments, the disease is a genetic disease or disorder. In some of embodiments, the CRISPR-Cas system or component thereof can modify one or more genes or polynucleotides associated with one or more genetic diseases such as any set forth in Table 12.

TABLE 12

| Exemplary Genes controlling Cellular Functions | |
|---|---|
| CELLULAR FUNCTION | GENES |
| PI3K/AKT Signaling | PRKCE; ITGAM; ITGA5; IRAK1; PRKAA2; EIF2AK2; PTEN; EIF4E; PRKCZ; GRK6; MAPK1; TSC1; PLK1; AKT2; IKBKB; PIK3CA; CDK8; CDKN1B; NFKB2; BCL2; PIK3CB; PPP2R1A; MAPK8; BCL2L1; MAPK3; TSC2; ITGA1; KRAS; EIF4EBP1; RELA; PRKCD; NOS3; PRKAA1; MAPK9; CDK2; PPP2CA; PIM1; ITGB7; YWHAZ; ILK; TP53; RAF1; IKBKG; RELB; DYRK1A; CDKN1A; ITGB1; MAP2K2; JAK1; AKT1; JAK2; PIK3R1; CHUK; PDPK1; PPP2R5C; CTNNB1; MAP2K1; NFKB1; PAK3; ITGB3; CCND1; GSK3A; FRAP1; SFN; ITGA2; TTK; CSNK1A1; BRAF; GSK3B; AKT3; FOXO1; SGK; HSP90AA1; RPS6KB1 |
| ERK/MAPK Signaling | PRKCE; ITGAM; ITGA5; HSPB1; IRAK1; PRKAA2; EIF2AK2; RAC1; RAP1A; TLN1; EIF4E; ELK1; GRK6; MAPK1; RAC2; PLK1; AKT2; PIK3CA; CDK8; CREB1; PRKCI; PTK2; FOS; RPS6KA4; PIK3CB; PPP2R1A; PIK3C3; MAPK8; MAPK3; ITGA1; ETS1; KRAS; MYCN; EIF4EBP1; PPARG; PRKCD; PRKAA1; MAPK9; SRC; CDK2; PPP2CA; PIM1; PIK3C2A; ITGB7; YWHAZ; PPP1CC; KSR1; PXN; RAF1; FYN; DYRK1A; ITGB1; MAP2K2; PAK4; PIK3R1; STAT3; PPP2R5C; MAP2K1; PAK3; ITGB3; ESR1; ITGA2; MYC; TTK; CSNK1A1; CRKL; BRAF; ATF4; PRKCA; SRF; STAT1; SGK |
| Glucocorticoid Receptor Signaling | RAC1; TAF4B; EP300; SMAD2; TRAF6; PCAF; ELK1; MAPK1; SMAD3; AKT2; IKBKB; NCOR2; UBE2I; PIK3CA; CREB1; FOS; HSPA5; NFKB2; BCL2; MAP3K14; STAT5B; PIK3CB; PIK3C3; MAPK8; BCL2L1; MAPK3; TSC22D3; MAPK10; NRIP1; KRAS; MAPK13; RELA; STAT5A; MAPK9; NOS2A; PBX1; NR3C1; PIK3C2A; CDKN1C; TRAF2; SERPINE1; NCOA3; MAPK14; TNF; RAF1; IKBKG; MAP3K7; CREBBP; CDKN1A; MAP2K2; JAK1; IL8; NCOA2; AKT1; JAK2; PIK3R1; CHUK; STAT3; MAP2K1; NFKB1; TGFBR1; ESR1; SMAD4; CEBPB; JUN; AR; AKT3; CCL2; MMP1; STAT1; IL6; HSP90AA1 |
| Axonal Guidance Signaling | PRKCE; ITGAM; ROCK1; ITGA5; CXCR4; ADAM12; IGF1; RAC1; RAP1A; EIF4E; PRKCZ; NRP1; NTRK2; ARHGEF7; SMO; ROCK2; MAPK1; PGF; RAC2; PTPN11; GNAS; AKT2; PIK3CA; ERBB2; PRKCI; PTK2; CFL1; GNAQ; PIK3CB; CXCL12; PIK3C3; WNT11; PRKD1; GNB2L1; ABL1; MAPK3; ITGA1; KRAS; RHOA; PRKCD; PIK3C2A; ITGB7; GLI2; PXN; VASP; RAF1; FYN; ITGB1; MAP2K2; PAK4; ADAM17; AKT1; PIK3R1; GLI1; WNT5A; ADAM10; MAP2K1; PAK3; ITGB3; CDC42; VEGFA; ITGA2; EPHA8; CRKL; RND1; GSK3B; AKT3; PRKCA |
| Ephrin Receptor Signaling Actin Cytoskeleton Signaling | PRKCE; ITGAM; ROCK1; ITGA5; CXCR4; IRAK1; PRKAA2; EIF2AK2; RAC1; RAP1A; GRK6; ROCK2; MAPK1; PGF; RAC2; PTPN11; GNAS; PLK1; AKT2; DOK1; CDK8; CREB1; PTK2; CFL1; GNAQ; MAP3K14; CXCL12; MAPK8; GNB2L1; ABL1; MAPK3; ITGA1; KRAS; RHOA; PRKCD; PRKAA1; MAPK9; SRC; CDK2; PIM1; ITGB7; PXN; RAF1; FYN; DYRK1A; ITGB1; MAP2K2; PAK4; AKT1; JAK2; STAT3; ADAM10; MAP2K1; PAK3; ITGB3; CDC42; VEGFA; ITGA2; EPHA8; TTK; CSNK1A1; CRKL; BRAF; PTPN13; ATF4; AKT3; SGK<br>ACTN4; PRKCE; ITGAM; ROCK1; ITGA5; IRAK1; PRKAA2; EIF2AK2; RAC1; INS; ARHGEF7; GRK6; ROCK2; MAPK1; RAC2; PLK1; AKT2; PIK3CA; CDK8; PTK2; CFL1; PIK3CB; MYH9; DIAPH1; PIK3C3; MAPK8; F2R; MAPK3; SLC9A1; ITGA1; KRAS; RHOA; PRKCD; PRKAA1; MAPK9; CDK2; PIM1; PIK3C2A; ITGB7; PPP1CC; PXN; VIL2; RAF1; GSN; DYRK1A; ITGB1; MAP2K2; PAK4; PIP5K1A; PIK3R1; MAP2K1; PAK3; ITGB3; CDC42; APC; ITGA2; TTK; CSNK1A1; CRKL; BRAF; VAV3; SGK |
| Huntington's Disease Signaling | PRKCE; IGF1; EP300; RCOR1; PRKCZ; HDAC4; TGM2; MAPK1; CAPNS1; AKT2; EGFR; NCOR2; SP1; CAPN2; PIK3CA; HDAC5; CREB1; PRKCI; HSPA5; REST; GNAQ; PIK3CB; PIK3C3; MAPK8; IGF1R; PRKD1; GNB2L1; BCL2L1; CAPN1; MAPK3; CASP8; HDAC2; HDACTA; PRKCD; HDAC11; MAPK9; HDAC9; PIK3C2A; HDAC3; TP53; CASP9; CREBBP; AKT1; PIK3R1; PDPK1; CASP1; APAF1; FRAP1; CASP2; JUN; BAX; ATF4; AKT3; PRKCA; CLTC; SGK; HDAC6; CASP3 |

TABLE 12-continued

Exemplary Genes controlling Cellular Functions

| CELLULAR FUNCTION | GENES |
| --- | --- |
| Apoptosis Signaling | PRKCE; ROCK1; BID; IRAK1; PRKAA2; EIF2AK2; BAK1; BIRC4; GRK6; MAPK1; CAPNS1; PLK1; AKT2; IKBKB; CAPN2; CDK8; FAS; NFKB2; BCL2; MAP3K14; MAPK8; BCL2L1; CAPN1; MAPK3; CASP8; KRAS; RELA; PRKCD; PRKAA1; MAPK9; CDK2; PIM1; TP53; TNF; RAF1; IKBKG; RELB; CASP9; DYRK1A; MAP2K2; CHUK; APAF1; MAP2K1; NFKB1; PAK3; LMNA; CASP2; BIRC2; TTK; CSNK1A1; BRAF; BAX; PRKCA; SGK; CASP3; BIRC3; PARP1 |
| B Cell Receptor Signaling | RAC1; PTEN; LYN; ELK1; MAPK1; RAC2; PTPN11; AKT2; IKBKB; PIK3CA; CREB1; SYK; NFKB2; CAMK2A; MAP3K14; PIK3CB; PIK3C3; MAPK8; BCL2L1; ABL1; MAPK3; ETS1; KRAS; MAPK13; RELA; PTPN6; MAPK9; EGR1; PIK3C2A; BTK; MAPK14; RAF1; IKBKG; RELB; MAP3K7; MAP2K2; AKT1; PIK3R1; CHUK; MAP2K1; NFKB1; CDC42; GSK3A; FRAP1; BCL6; BCL10; JUN; GSK3B; ATF4; AKT3; VAV3; RPS6KB1 |
| Leukocyte Extravasation Signaling | ACTN4; CD44; PRKCE; ITGAM; ROCK1; CXCR4; CYBA; RAC1; RAP1A; PRKCZ; ROCK2; RAC2; PTPN11; MMP14; PIK3CA; PRKCI; PTK2; PIK3CB; CXCL12; PIK3C3; MAPK8; PRKD1; ABL1; MAPK10; CYBB; MAPK13; RHOA; PRKCD; MAPK9; SRC; PIK3C2A; BTK; MAPK14; NOX1; PXN; VIL2; VASP; ITGB1; MAP2K2; CTNND1; PIK3R1; CTNNB1; CLDN1; CDC42; F11R; ITK; CRKL; VAV3; CTTN; PRKCA; MMP1; MMP9 |
| Integrin Signaling | ACTN4; ITGAM; ROCK1; ITGA5; RAC1; PTEN; RAP1A; TLN1; ARHGEF7; MAPK1; RAC2; CAPNS1; AKT2; CAPN2; PIK3CA; PTK2; PIK3CB; PIK3C3; MAPK8; CAV1; CAPN1; ABL1; MAPK3; ITGA1; KRAS; RHOA; SRC; PIK3C2A; ITGB7; PPP1CC; ILK; PXN; VASP; RAF1; FYN; ITGB1; MAP2K2; PAK4; AKT1; PIK3R1; TNK2; MAP2K1; PAK3; ITGB3; CDC42; RND3; ITGA2; CRKL; BRAF; GSK3B; AKT3 |
| Acute Phase Response Signaling | IRAK1; SOD2; MYD88; TRAF6; ELK1; MAPK1; PTPN11; AKT2; IKBKB; PIK3CA; FOS; NFKB2; MAP3K14; PIK3CB; MAPK8; RIPK1; MAPK3; IL6ST; KRAS; MAPK13; IL6R; RELA; SOCS1; MAPK9; FTL; NR3C1; TRAF2; SERPINE1; MAPK14; TNF; RAF1; PDK1; IKBKG; RELB; MAP3K7; MAP2K2; AKT1; JAK2; PIK3R1; CHUK; STAT3; MAP2K1; NFKB1; FRAP1; CEBPB; JUN; AKT3; IL1R1; IL6 |
| PTEN Signaling | ITGAM; ITGA5; RAC1; PTEN; PRKCZ; BCL2L11; MAPK1; RAC2; AKT2; EGFR; IKBKB; CBL; PIK3CA; CDKN1B; PTK2; NFKB2; BCL2; PIK3CB; BCL2L1; MAPK3; ITGA1; KRAS; ITGB7; ILK; PDGFRB; INSR; RAF1; IKBKG; CASP9; CDKN1A; ITGB1; MAP2K2; AKT1; PIK3R1; CHUK; PDGFRA; PDPK1; MAP2K1; NFKB1; ITGB3; CDC42; CCND1; GSK3A; ITGA2; GSK3B; AKT3; FOXO1; CASP3; RPS6KB1 |
| p53 Signaling | PTEN; EP300; BBC3; PCAF; FASN; BRCA1; GADD45A; BIRC5; AKT2; PIK3CA; CHEK1; TP53INP1; BCL2; PIK3CB; PIK3C3; MAPK8; THBS1; ATR; BCL2L1; E2F1; PMAIP1; CHEK2; TNFRSF10B; TP73; RB1; HDAC9; CDK2; PIK3C2A; MAPK14; TP53; LRDD; CDKN1A; HIPK2; AKT1; PIK3R1; RRM2B; APAF1; CTNNB1; SIRT1; CCND1; PRKDC; ATM; SFN; CDKN2A; JUN; SNAI2; GSK3B; BAX; AKT3 |
| Aryl Hydrocarbon Receptor Signaling | HSPB1; EP300; FASN; TGM2; RXRA; MAPK1; NQO1; NCOR2; SP1; ARNT; CDKN1B; FOS; CHEK1; SMARCA4; NFKB2; MAPK8; ALDH1A1; ATR; E2F1; MAPK3; NRIP1; CHEK2; RELA; TP73; GSTP1; RB1; SRC; CDK2; AHR; NFE2L2; NCOA3; TP53; TNF; CDKN1A; NCOA2; APAF1; NFKB1; CCND1; ATM; ESR1; CDKN2A; MYC; JUN; ESR2; BAX; IL6; CYP1B1; HSP90AA1 |
| Xenobiotic Metabolism Signaling | PRKCE; EP300; PRKCZ; RXRA; MAPK1; NQO1; NCOR2; PIK3CA; ARNT; PRKCI; NFKB2; CAMK2A; PIK3CB; PPP2R1A; PIK3C3; MAPK8; PRKD1; ALDH1A1; MAPK3; NRIP1; KRAS; MAPK13; PRKCD; GSTP1; MAPK9; NOS2A; ABCB1; AHR; PPP2CA; FTL; NFE2L2; PIK3C2A; PPARGC1A; MAPK14; TNF; RAF1; CREBBP; MAP2K2; PIK3R1; PPP2R5C; MAP2K1; NFKB1; KEAP1; PRKCA; EIF2AK3; IL6; CYP1B1; HSP90AA1 |

TABLE 12-continued

Exemplary Genes controlling Cellular Functions

| CELLULAR FUNCTION | GENES |
|---|---|
| SAPK/JNK Signaling | PRKCE; IRAK1; PRKAA2; EIF2AK2; RAC1; ELK1; GRK6; MAPK1; GADD45A; RAC2; PLK1; AKT2; PIK3CA; FADD; CDK8; PIK3CB; PIK3C3; MAPK8; RIPK1; GNB2L1; IRS1; MAPK3; MAPK10; DAXX; KRAS; PRKCD; PRKAA1; MAPK9; CDK2; PIM1; PIK3C2A; TRAF2; TP53; LCK; MAP3K7; DYRK1A; MAP2K2; PIK3R1; MAP2K1; PAK3; CDC42; JUN; TTK; CSNK1A1; CRKL; BRAF; SGK |
| PPAr/RXR Signaling | PRKAA2; EP300; INS; SMAD2; TRAF6; PPARA; FASN; RXRA; MAPK1; SMAD3; GNAS; IKBKB; NCOR2; ABCA1; GNAQ; NFKB2; MAP3K14; STAT5B; MAPK8; IRS1; MAPK3; KRAS; RELA; PRKAA1; PPARGC1A; NCOA3; MAPK14; INSR; RAF1; IKBKG; RELB; MAP3K7; CREBBP; MAP2K2; JAK2; CHUK; MAP2K1; NFKB1; TGFBR1; SMAD4; JUN; IL1R1; PRKCA; IL6; HSP90AA1; ADIPOQ |
| NF-KB Signaling | IRAK1; EIF2AK2; EP300; INS; MYD88; PRKCZ; TRAF6; TBK1; AKT2; EGFR; IKBKB; PIK3CA; BTRC; NFKB2; MAP3K14; PIK3CB; PIK3C3; MAPK8; RIPK1; HDAC2; KRAS; RELA; PIK3C2A; TRAF2; TLR4; PDGFRB; TNF; INSR; LCK; IKBKG; RELB; MAP3K7; CREBBP; AKT1; PIK3R1; CHUK; PDGFRA; NFKB1; TLR2; BCL10; GSK3B; AKT3; TNFAIP3; IL1R1 |
| Neuregulin Signaling | ERBB4; PRKCE; ITGAM; ITGA5; PTEN; PRKCZ; ELK1; MAPK1; PTPN11; AKT2; EGFR; ERBB2; PRKCI; CDKN1B; STAT5B; PRKD1; MAPK3; ITGA1; KRAS; PRKCD; STAT5A; SRC; ITGB7; RAF1; ITGB1; MAP2K2; ADAM17; AKT1; PIK3R1; PDPK1; MAP2K1; ITGB3; EREG; FRAP1; PSEN1; ITGA2; MYC; NRG1; CRKL; AKT3; PRKCA; HSP90AA1; RPS6KB1 |
| Wnt & Beta catenin Signaling | CD44; EP300; LRP6; DVL3; CSNK1E; GJA1; SMO; AKT2; PIN1; CDH1; BTRC; GNAQ; MARK2; PPP2R1A; WNT11; SRC; DKK1; PPP2CA; SOX6; SFRP2; ILK; LEF1; SOX9; TP53; MAP3K7; CREBBP; TCF7L2; AKT1; PPP2R5C; WNT5A; LRP5; CTNNB1; TGFBR1; CCND1; GSK3A; DVL1; APC; CDKN2A; MYC; CSNK1A1; GSK3B; AKT3; SOX2 |
| Insulin Receptor Signaling | PTEN; INS; EIF4E; PTPN1; PRKCZ; MAPK1; TSC1; PTPN11; AKT2; CBL; PIK3CA; PRKCI; PIK3CB; PIK3C3; MAPK8; IRS1; MAPK3; TSC2; KRAS; EIF4EBP1; SLC2A4; PIK3C2A; PPP1CC; INSR; RAF1; FYN; MAP2K2; JAK1; AKT1; JAK2; PIK3R1; PDPK1; MAP2K1; GSK3A; FRAP1; CRKL; GSK3B; AKT3; FOXO1; SGK; RPS6KB1 |
| IL-6 Signaling | HSPB1; TRAF6; MAPKAPK2; ELK1; MAPK1; PTPN11; IKBKB; FOS; NFKB2; MAP3K14; MAPK8; MAPK3; MAPK10; IL6ST; KRAS; MAPK13; IL6R; RELA; SOCS1; MAPK9; ABCB1; TRAF2; MAPK14; TNF; RAF1; IKBKG; RELB; MAP3K7; MAP2K2; IL8; JAK2; CHUK; STAT3; MAP2K1; NFKB1; CEBPB; JUN; IL1R1; SRF; IL6 |
| Hepatic Cholestasis | PRKCE; IRAK1; INS; MYD88; PRKCZ; TRAF6; PPARA; RXRA; IKBKB; PRKCI; NFKB2; MAP3K14; MAPK8; PRKD1; MAPK10; RELA; PRKCD; MAPK9; ABCB1; TRAF2; TLR4; TNF; INSR; IKBKG; RELB; MAP3K7; IL8; CHUK; NR1H2; TJP2; NFKB1; ESR1; SREBF1; FGFR4; JUN; IL1R1; PRKCA; IL6 |
| IGF-1 Signaling | IGF1; PRKCZ; ELK1; MAPK1; PTPN11; NEDD4; AKT2; PIK3CA; PRKCI; PTK2; FOS; PIK3CB; PIK3C3; MAPK8; IGF1R; IRS1; MAPK3; IGFBP7; KRAS; PIK3C2A; YWHAZ; PXN; RAF1; CASP9; MAP2K2; AKT1; PIK3R1; PDPK1; MAP2K1; IGFBP2; SFN; JUN; CYR61; AKT3; FOXO1; SRF; CTGF; RPS6KB1 |
| NRF2-mediated Oxidative Stress Response | PRKCE; EP300; SOD2; PRKCZ; MAPK1; SQSTM1; NQO1; PIK3CA; PRKCI; FOS; PIK3CB; PIK3C3; MAPK8; PRKD1; MAPK3; KRAS; PRKCD; GSTP1; MAPK9; FTL; NFE2L2; PIK3C2A; MAPK14; RAF1; MAP3K7; CREBBP; MAP2K2; AKT1; PIK3R1; MAP2K1; PPIB; JUN; KEAP1; GSK3B; ATF4; PRKCA; EIF2AK3; HSP90AA1 |
| Hepatic Fibrosis/Hepatic Stellate Cell Activation | EDN1; IGF1; KDR; FLT1; SMAD2; FGFR1; MET; PGF; SMAD3; EGFR; FAS; CSF1; NFKB2; BCL2; MYH9; IGF1R; IL6R; RELA; TLR4; PDGFRB; TNF; RELB; IL8; PDGFRA; NFKB1; TGFBR1; SMAD4; VEGFA; BAX; IL1R1; CCL2; HGF; MMP1; STAT1; IL6; CTGF; MMP9 |
| PPAR Signaling | EP300; INS; TRAF6; PPARA; RXRA; MAPK1; IKBKB; NCOR2; FOS; NFKB2; MAP3K14; STAT5B; MAPK3; NRIP1; KRAS; PPARG; RELA; STAT5A; TRAF2; |

TABLE 12-continued

Exemplary Genes controlling Cellular Functions

| CELLULAR FUNCTION | GENES |
|---|---|
| Fc Epsilon RI Signaling | PPARGC1A; PDGFRB; TNF; INSR; RAF1; IKBKG; RELB; MAP3K7; CREBBP; MAP2K2; CHUK; PDGFRA; MAP2K1; NFKB1; JUN; IL1R1; HSP90AA1 PRKCE; RAC1; PRKCZ; LYN; MAPK1; RAC2; PTPN11; AKT2; PIK3CA; SYK; PRKCI; PIK3CB; PIK3C3; MAPK8; PRKD1; MAPK3; MAPK 10; KRAS; MAPK13; PRKCD; MAPK9; PIK3C2A; BTK; MAPK14; TNF; RAF1; FYN; MAP2K2; AKT1; PIK3R1; PDPK1; MAP2K1; AKT3; VAV3; PRKCA |
| G-Protein Coupled Receptor Signaling | PRKCE; RAP1A; RGS16; MAPK1; GNAS; AKT2; IKBKB; PIK3CA; CREB1; GNAQ; NFKB2; CAMK2A; PIK3CB; PIK3C3; MAPK3; KRAS; RELA; SRC; PIK3C2A; RAF1; IKBKG; RELB; FYN; MAP2K2; AKT1; PIK3R1; CHUK; PDPK1; STAT3; MAP2K1; NFKB1; BRAF; ATF4; AKT3; PRKCA |
| Inositol Phosphate Metabolism | PRKCE; IRAK1; PRKAA2; EIF2AK2; PTEN; GRK6; MAPK1; PLK1; AKT2; PIK3CA; CDK8; PIK3CB; PIK3C3; MAPK8; MAPK3; PRKCD; PRKAA1; MAPK9; CDK2; PIM1; PIK3C2A; DYRK1A; MAP2K2; PIP5K1A; PIK3R1; MAP2K1; PAK3; ATM; TTK; CSNK1A1; BRAF; SGK |
| PDGF Signaling | EIF2AK2; ELK1; ABL2; MAPK1; PIK3CA; FOS; PIK3CB; PIK3C3; MAPK8; CAV1; ABL1; MAPK3; KRAS; SRC; PIK3C2A; PDGFRB; RAF1; MAP2K2; JAK1; JAK2; PIK3R1; PDGFRA; STAT3; SPHK1; MAP2K1; MYC; JUN; CRKL; PRKCA; SRF; STAT1; SPHK2 |
| VEGF Signaling | ACTN4; ROCK1; KDR; FLT1; ROCK2; MAPK1; PGF; AKT2; PIK3CA; ARNT; PTK2; BCL2; PIK3CB; PIK3C3; BCL2L1; MAPK3; KRAS; HIF1A; NOS3; PIK3C2A; PXN; RAF1; MAP2K2; ELAVL1; AKT1; PIK3R1; MAP2K1; SFN; VEGFA; AKT3; FOXO1; PRKCA |
| Natural Killer Cell Signaling | PRKCE; RAC1; PRKCZ; MAPK1; RAC2; PTPN11; KIR2DL3; AKT2; PIK3CA; SYK; PRKCI; PIK3CB; PIK3C3; PRKD1; MAPK3; KRAS; PRKCD; PTPN6; PIK3C2A; LCK; RAF1; FYN; MAP2K2; PAK4; AKT1; PIK3R1; MAP2K1; PAK3; AKT3; VAV3; PRKCA |
| Cell Cycle: G1/S Checkpoint Regulation | HDAC4; SMAD3; SUV39H1; HDAC5; CDKN1B; BTRC; ATR; ABL1; E2F1; HDAC2; HDAC7A; RB1; HDAC11; HDAC9; CDK2; E2F2; HDAC3; TP53; CDKN1A; CCND1; E2F4; ATM; RBL2; SMAD4; CDKN2A; MYC; NRG1; GSK3B; RBL1; HDAC6 |
| T Cell Receptor Signaling | RAC1; ELK1; MAPK1; IKBKB; CBL; PIK3CA; FOS; NFKB2; PIK3CB; PIK3C3; MAPK8; MAPK3; KRAS; RELA; PIK3C2A; BTK; LCK; RAF1; IKBKG; RELB; FYN; MAP2K2; PIK3R1; CHUK; MAP2K1; NFKB1; ITK; BCL10; JUN; VAV3 |
| Death Receptor Signaling | CRADD; HSPB1; BID; BIRC4; TBK1; IKBKB; FADD; FAS; NFKB2; BCL2; MAP3K14; MAPK8; RIPK1; CASP8; DAXX; TNFRSF10B; RELA; TRAF2; TNF; IKBKG; RELB; CASP9; CHUK; APAF1; NFKB1; CASP2; BIRC2; CASP3; BIRC3 |
| FGF Signaling | RAC1; FGFR1; MET; MAPKAPK2; MAPK1; PTPN11; AKT2; PIK3CA; CREB1; PIK3CB; PIK3C3; MAPK8; MAPK3; MAPK13; PTPN6; PIK3C2A; MAPK14; RAF1; AKT1; PIK3R1; STAT3; MAP2K1; FGFR4; CRKL; ATF4; AKT3; PRKCA; HGF |
| GM-CSF Signaling | LYN; ELK1; MAPK1; PTPN11; AKT2; PIK3CA; CAMK2A; STAT5B; PIK3CB; PIK3C3; GNB2L1; BCL2L1; MAPK3; ETS1; KRAS; RUNX1; PIM1; PIK3C2A; RAF1; MAP2K2; AKT1; JAK2; PIK3R1; STAT3; MAP2K1; CCND1; AKT3; STAT1 |
| Amyotrophic Lateral Sclerosis Signaling | BID; IGF1; RAC1; BIRC4; PGF; CAPNS1; CAPN2; PIK3CA; BCL2; PIK3CB; PIK3C3; BCL2L1; CAPN1; PIK3C2A; TP53; CASP9; PIK3R1; RAB5A; CASP1; APAF1; VEGFA; BIRC2; BAX; AKT3; CASP3; BIRC3 |
| JAK/Stat Signaling | PTPN1; MAPK1; PTPN11; AKT2; PIK3CA; STAT5B; PIK3CB; PIK3C3; MAPK3; KRAS; SOCS1; STAT5A; PTPN6; PIK3C2A; RAF1; CDKN1A; MAP2K2; JAK1; AKT1; JAK2; PIK3R1; STAT3; MAP2K1; FRAP1; AKT3; STAT1 |
| Nicotinate and Nicotinamide Metabolism | PRKCE; IRAK1; PRKAA2; EIF2AK2; GRK6; MAPK1; PLK1; AKT2; CDK8; MAPK8; MAPK3; PRKCD; PRKAA1; PBEF 1; MAPK9; CDK2; PIM1; DYRK1A; MAP2K2; MAP2K1; PAK3; NT5E; TTK; CSNK1A1; BRAF; SGK |

TABLE 12-continued

Exemplary Genes controlling Cellular Functions

| CELLULAR FUNCTION | GENES |
|---|---|
| Chemokine Signaling | CXCR4; ROCK2; MAPK1; PTK2; FOS; CFL1; GNAQ; CAMK2A; CXCL12; MAPK8; MAPK3; KRAS; MAPK13; RHOA; CCR3; SRC; PPP1CC; MAPK14; NOX1; RAF1; MAP2K2; MAP2K1; JUN; CCL2; PRKCA |
| IL-2 Signaling | ELK1; MAPK1; PTPN11; AKT2; PIK3CA; SYK; FOS; STAT5B; PIK3CB; PIK3C3; MAPK8; MAPK3; KRAS; SOCS1; STAT5A; PIK3C2A; LCK; RAF1; MAP2K2; JAK1; AKT1; PIK3R1; MAP2K1; JUN; AKT3 |
| Synaptic Long Term Depression | PRKCE; IGF1; PRKCZ; PRDX6; LYN; MAPK1; GNAS; PRKCI; GNAQ; PPP2R1A; IGF1R; PRKD1; MAPK3; KRAS; GRN; PRKCD; NOS3; NOS2A; PPP2CA; YWHAZ; RAF1; MAP2K2; PPP2R5C; MAP2K1; PRKCA |
| Estrogen Receptor Signaling | TAF4B; EP300; CARM1; PCAF; MAPK1; NCOR2; SMARCA4; MAPK3; NRIP1; KRAS; SRC; NR3C1; HDAC3; PPARGC1A; RBM9; NCOA3; RAF1; CREBBP; MAP2K2; NCOA2; MAP2K1; PRKDC; ESR1; ESR2 |
| Protein Ubiquitination Pathway | TRAF6; SMURF1; BIRC4; BRCA1; UCHL1; NEDD4; CBL; UBE2I; BTRC; HSPA5; USP7; USP10; FBXW7; USP9X; STUB1; USP22; B2M; BIRC2; PARK2; USP8; USP1; VHL; HSP90AA1; BIRC3 |
| IL-10 Signaling | TRAF6; CCR1; ELK1; IKBKB; SP1; FOS; NFKB2; MAP3K14; MAPK8; MAPK 13; RELA; MAPK14; TNF; IKBKG; RELB; MAP3K7; JAK1; CHUK; STAT3; NFKB1; JUN; IL1R1; IL6 |
| VDR/RXR Activation | PRKCE; EP300; PRKCZ; RXRA; GADD45A; HES1; NCOR2; SP1; PRKCI; CDKN1B; PRKD1; PRKCD; RUNX2; KLF4; YY1; NCOA3; CDKN1A; NCOA2; SPP1; LRP5; CEBPB; FOXO1; PRKCA |
| TGF-beta Signaling | EP300; SMAD2; SMURF1; MAPK1; SMAD3; SMAD1; FOS; MAPK8; MAPK3; KRAS; MAPK9; RUNX2; SERPINE1; RAF1; MAP3K7; CREBBP; MAP2K2; MAP2K1; TGFBR1; SMAD4; JUN; SMAD5 |
| Toll-like Receptor Signaling | IRAK1; EIF2AK2; MYD88; TRAF6; PPARA; ELK1; IKBKB; FOS; NFKB2; MAP3K14; MAPK8; MAPK13; RELA; TLR4; MAPK14; IKBKG; RELB; MAP3K7; CHUK; NFKB1; TLR2; JUN |
| p38 MAPK Signaling | HSPB1; IRAK1; TRAF6; MAPKAPK2; ELK1; FADD; FAS; CREB1; DDIT3; RPS6KA4; DAXX; MAPK13; TRAF2; MAPK14; TNF; MAP3K7; TGFBR1; MYC; ATF4; IL1R1; SRF; STAT1 |
| Neurotrophin/TRK Signaling | NTRK2; MAPK1; PTPN11; PIK3CA; CREB1; FOS; PIK3CB; PIK3C3; MAPK8; MAPK3; KRAS; PIK3C2A; RAF1; MAP2K2; AKT1; PIK3R1; PDPK1; MAP2K1; CDC42; JUN; ATF4 |
| FXR/RXR Activation | INS; PPARA; FASN; RXRA; AKT2; SDC1; MAPK8; APOB; MAPK10; PPARG; MTTP; MAPK9; PPARGC1A; TNF; CREBBP; AKT1; SREBF1; FGFR4; AKT3; FOXO1 |
| Synaptic Long Term Potentiation | PRKCE; RAP1A; EP300; PRKCZ; MAPK1; CREB1; PRKCI; GNAQ; CAMK2A; PRKD1; MAPK3; KRAS; PRKCD; PPP1CC; RAF1; CREBBP; MAP2K2; MAP2K1; ATF4; PRKCA |
| Calcium Signaling | RAP1A; EP300; HDAC4; MAPK1; HDAC5; CREB1; CAMK2A; MYH9; MAPK3; HDAC2; HDAC7A; HDAC11; HDAC9; HDAC3; CREBBP; CALR; CAMKK2; ATF4; HDAC6 |
| EGF Signaling | ELK1; MAPK1; EGFR; PIK3CA; FOS; PIK3CB; PIK3C3; MAPK8; MAPK3; PIK3C2A; RAF1; JAK1; PIK3R1; STAT3; MAP2K1; JUN; PRKCA; SRF; STAT1 |
| Hypoxia Signaling in the Cardiovascular System | EDN1; PTEN; EP300; NQO1; UBE2I; CREB1; ARNT; HIF1A; SLC2A4; NOS3; TP53; LDHA; AKT1; ATM; VEGFA; JUN; ATF4; VHL; HSP90AA1 |
| LPS/IL-1 Mediated Inhibition of RXR Function | IRAK1; MYD88; TRAF6; PPARA; RXRA; ABCA1; MAPK8; ALDH1A1; GSTP1; MAPK9; ABCB1; TRAF2; TLR4; TNF; MAP3K7; NR1H2; SREBF1; JUN; IL1R1 |
| LXR/RXR Activation | FASN; RXRA; NCOR2; ABCA1; NFKB2; IRF3; RELA; NOS2A; TLR4; TNF; RELB; LDLR; NR1H2; NFKB1; SREBF1; IL1R1; CCL2; IL6; MMP9 |
| Amyloid Processing | PRKCE; CSNK1E; MAPK1; CAPNS1; AKT2; CAPN2; CAPN1; MAPK3; MAPK13; MAPT; MAPK14; AKT1; PSEN1; CSNK1A1; GSK3B; AKT3; APP |
| IL-4 Signaling | AKT2; PIK3CA; PIK3CB; PIK3C3; IRS1; KRAS; SOCS1; PTPN6; NR3C1; PIK3C2A; JAK1; AKT1; JAK2; PIK3R1; FRAP1; AKT3; RPS6KB1 |

TABLE 12-continued

Exemplary Genes controlling Cellular Functions

| CELLULAR FUNCTION | GENES |
|---|---|
| Cell Cycle: G2/M DNA Damage Checkpoint Regulation | EP300; PCAF; BRCA1; GADD45A; PLK1; BTRC; CHEK1; ATR; CHEK2; YWHAZ; TP53; CDKN1A; PRKDC; ATM; SFN; CDKN2A |
| Nitric Oxide Signaling in the Cardiovascular System | KDR; FLT1; PGF; AKT2; PIK3CA; PIK3CB; PIK3C3; CAV1; PRKCD; NOS3; PIK3C2A; AKT1; PIK3R1; VEGFA; AKT3; HSP90AA1 |
| Purine Metabolism | NME2; SMARCA4; MYH9; RRM2; ADAR; EIF2AK4; PKM2; ENTPD1; RAD51; RRM2B; TJP2; RAD51C; NT5E; POLD1; NME1 |
| CAMP-mediated Signaling | RAP1A; MAPK1; GNAS; CREB1; CAMK2A; MAPK3; SRC; RAF1; MAP2K2; STAT3; MAP2K1; BRAF; ATF4 |
| Mitochondrial Dysfunction | SOD2; MAPK8; CASP8; MAPK10; MAPK9; CASP9; PARK7; PSEN1; PARK2; APP; CASP3 |
| Notch Signaling | HES1; JAG1; NUMB; NOTCH4; ADAM17; NOTCH2; PSEN1; NOTCH3; NOTCH1; DLL4 |
| Endoplasmic Reticulum Stress Pathway | HSPA5; MAPK8; XBP1; TRAF2; ATF6; CASP9; ATF4; EIF2AK3; CASP3 |
| Pyrimidine Metabolism | NME2; AICDA; RRM2; EIF2AK4; ENTPD1; RRM2B; NT5E; POLD1; NME1 |
| Parkinson's Signaling | UCHL1; MAPK8; MAPK13; MAPK14; CASP9; PARK7; PARK2; CASP3 |
| Cardiac & Beta Adrenergic Signaling | GNAS; GNAQ; PPP2R1A; GNB2L1; PPP2CA; PPP1CC; PPP2R5C |
| Glycolysis/Gluconeogenesis | HK2; GCK; GPI; ALDH1A1; PKM2; LDHA; HK1 |
| Interferon Signaling | IRF1; SOCS1; JAK1; JAK2; IFITM1; STAT1; IFIT3 |
| Sonic Hedgehog Signaling | ARRB2; SMO; GLI2; DYRK1A; GLI1; GSK3B; DYRK1B |
| Glycerophospholipid Metabolism | PLD1; GRN; GPAM; YWHAZ; SPHK1; SPHK2 |
| Phospholipid Degradation | PRDX6; PLD1; GRN; YWHAZ; SPHK1; SPHK2 |
| Tryptophan Metabolism | SIAH2; PRMT5; NEDD4; ALDH1A1; CYP1B1; SIAH1 |
| Lysine Degradation | SUV39H1; EHMT2; NSD1; SETD7; PPP2R5C |
| Nucleotide Excision Repair Pathway | ERCC5; ERCC4; XPA; XPC; ERCC1 |
| Starch and Sucrose Metabolism | UCHL1; HK2; GCK; GPI; HK1 |
| Aminosugars Metabolism | NQO1; HK2; GCK; HK1 |
| Arachidonic Acid Metabolism | PRDX6; GRN; YWHAZ; CYP1B1 |
| Circadian Rhythm Signaling | CSNK1E; CREB1; ATF4; NR1D1 |
| Coagulation System | BDKRB1; F2R; SERPINE1; F3 |
| Dopamine Receptor Signaling | PPP2R1A; PPP2CA; PPP1CC; PPP2R5C |
| Glutathione Metabolism | IDH2; GSTP1; ANPEP; IDH1 |
| Glycerolipid Metabolism | ALDH1A1; GPAM; SPHK1; SPHK2 |
| Linoleic Acid Metabolism | PRDX6; GRN; YWHAZ; CYP1B1 |
| Methionine Metabolism | DNMT1; DNMT3B; AHCY; DNMT3A |
| Pyruvate Metabolism | GLO1; ALDH1A1; PKM2; LDHA |
| Arginine and Proline Metabolism | ALDH1A1; NOS3; NOS2A |
| Eicosanoid Signaling | PRDX6; GRN; YWHAZ |
| Fructose and Mannose Metabolism | HK2; GCK; HK1 |
| Galactose Metabolism | HK2; GCK; HK1 |
| Stilbene, Coumarine and Lignin Biosynthesis | PRDX6; PRDX1; TYR |
| Antigen Presentation Pathway | CALR; B2M |
| Biosynthesis of Steroids | NQO1; DHCR7 |
| Butanoate Metabolism | ALDH1A1; NLGN1 |
| Citrate Cycle | IDH2; IDH1 |
| Fatty Acid Metabolism | ALDH1A1; CYP1B1 |
| Glycerophospholipid Metabolism | PRDX6; CHKA |
| Histidine Metabolism | PRMT5; ALDH1A1 |
| Inositol Metabolism | ERO1L; APEX1 |
| Metabolism of Xenobiotics by Cytochrome p450 | GSTP1; CYP1B1 |
| Methane Metabolism | PRDX6; PRDX1 |
| Phenylalanine Metabolism | PRDX6; PRDX1 |
| Propanoate Metabolism | ALDH1A1; LDHA |
| Selenoamino Acid Metabolism | PRMT5; AHCY |
| Sphingolipid Metabolism | SPHK1; SPHK2 |
| Aminophosphonate Metabolism | PRMT5 |

TABLE 12-continued

Exemplary Genes controlling Cellular Functions

| CELLULAR FUNCTION | GENES |
|---|---|
| Androgen and Estrogen Metabolism | PRMT5 |
| Ascorbate and Aldarate Metabolism | ALDH1A1 |
| Bile Acid Biosynthesis | ALDH1A1 |
| Cysteine Metabolism | LDHA |
| Fatty Acid Biosynthesis | FASN |
| Glutamate Receptor Signaling | GNB2L1 |
| NRF2-mediated Oxidative Stress Response | PRDX1 |
| Pentose Phosphate Pathway | GPI |
| Pentose and Glucuronate Interconversions | UCHL1 |
| Retinol Metabolism | ALDH1A1 |
| Riboflavin Metabolism | TYR |
| Tyrosine Metabolism | PRMT5, TYR |
| Ubiquinone Biosynthesis | PRMT5 |
| Valine, Leucine and Isoleucine Degradation | ALDH1A1 |
| Glycine, Serine and Threonine Metabolism | CHKA |
| Lysine Degradation | ALDH1A1 |
| Pain/Taste | TRPM5; TRPA1 |
| Pain | TRPM7; TRPC5; TRPC6; TRPC1; Cnr1; cnr2; Grk2; Trpa1; Pomc; Cgrp; Crf; Pka; Era; Nr2b; TRPM5; Prkaca; Prkacb; Prkar1a; Prkar2a |
| Mitochondrial Function | AIF; CytC; SMAC (Diablo); Aifm-1; Aifm-2 |
| Developmental Neurology | BMP-4; Chordin (Chrd); Noggin (Nog); WNT (Wnt2; Wnt2b; Wnt3a; Wnt4; Wnt5a; Wnt6; Wnt7b; Wnt8b; Wnt9a; Wnt9b; Wnt10a; Wnt10b; Wnt16); beta-catenin; Dkk-1; Frizzled related proteins; Otx-2; Gbx2; FGF-8; Reelin; Dab1; unc-86 (Pou4f1 or Brn3a); Numb; Reln |

Further non-limiting examples of disease-associated genes and polynucleotides and disease specific information is available from McKusick-Nathans Institute of Genetic Medicine, Johns Hopkins University (Baltimore, Md.) and National Center for Biotechnology Information, National Library of Medicine (Bethesda, Md.), available on the World Wide Web.

In some embodiments, a method of individualized or personalized treatment of a genetic disease in a subject in need of such treatment includes: (a) introducing one or more mutations ex vivo in a tissue, organ or a cell line, or in vivo in a transgenic non-human mammal, comprising delivering to cell(s) of the tissue, organ, cell or mammal a composition comprising the particle delivery system or the delivery system or the virus particle of any one of the above embodiment or the cell of any one of the above embodiment, wherein the specific mutations or precise sequence substitutions are or have been correlated to the genetic disease; (b) testing treatment(s) for the genetic disease on the cells to which the vector has been delivered that have the specific mutations or precise sequence substitutions correlated to the genetic disease; and (c) treating the subject based on results from the testing of treatment(s) of step (b).

Infectious Diseases

In some embodiments, the CRISPR-Cas system(s) or component(s) thereof can be used to diagnose, prognose, treat, and/or prevent an infectious disease caused by a microorganism, such as bacteria, virus, fungi, parasites, or combinations thereof.

In some embodiments, the Cas system(s) or component(s) thereof can be capable of targeting specific microorganism within a mixed population. Exemplary methods of such techniques are described in e.g. Gomaa A A, Klumpe H E, Luo M L, Selle K, Barrangou R, Beisel C L. 2014. Programmable removal of bacterial strains by use of genome-targeting CRISPR-Cas systems. mBio 5:e00928-13; Citorik R J, Mimee M, Lu T K. 2014. Sequence-specific antimicrobials using efficiently delivered RNA-guided nucleases. Nat Biotechnol 32:1141-1145, the teachings of which can be adapted for use with the CRISPR-Cas systems and components thereof described herein.

In some embodiments, the CRISPR-Cas system(s) and/or components thereof can be capable of targeting pathogenic and/or drug-resistant microorganisms, such as bacteria, virus, parasites, and fungi. In some embodiments, the CRISPR-Cas system(s) and/or components thereof can be capable of targeting and modifying one or more polynucleotides in a pathogenic microorganism such that the microorganism is less virulent, killed, inhibited, or is otherwise rendered incapable of causing disease and/or infecting and/or replicating in a host cell.

In some embodiments, the pathogenic bacteria that can be targeted and/or modified by the CRISPR-Cas system(s) and/or component(s) thereof described herein include, but are not limited to, those of the genus *Actinomyces* (e.g. *A. israelii*), *Bacillus* (e.g. *B. anthracis*, *B. cereus*), *Bacteroides* (e.g. *B. fragilis*), *Bartonella* (*B. henselae*, *B. quintana*), *Bordetella* (*B. pertussis*), *Borrelia* (e.g. *B. burgdorferi*, *B. garinii*, *B. afzelii*, and *B. recurreentis*), *Brucella* (e.g. *B. abortus*, *B. canis*, *B. melitensis*, and *B. suis*), *Campylobacter* (e.g. *C. jejuni*), *Chlamydia* (e.g. *C. pneumoniae* and *C. trachomatis*), *Chlamydophila* (e.g. *C. psittaci*), *Clostridium* (e.g. *C. botulinum, C. difficile, C. perfringens. C. tetani*), *Corynebacterium* (e.g. *C. diphtheriae*), *Enterococcus* (e.g.

E. *Faecalis, E. faecium*), *Ehrlichia* (*E. canis* and *E. chaffensis*) *Escherichia* (e.g. *E. coli*), *Francisella* (e.g. *F. tularensis*), *Haemophilus* (e.g. *H. influenzae*), *Helicobacter* (*H. pylori*), *Klebsiella* (E.g. *K. pneumoniae*), *Legionella* (e.g. *L. pneumophila*), *Leptospira* (e.g. *L. interrogans, L. santarosai, L. weilii, L. noguchii*), *Listereia* (e.g. *L. monocytogenes*), *Mycobacterium* (e.g. *M. leprae, M. tuberculosis, M. ulcerans*), *Mycoplasma* (*M. pneumoniae*), *Neisseria* (*N. gonorrhoeae* and *N. meningitidis*), *Nocardia* (e.g. *N. asteroides*), *Pseudomonas* (*P. aeruginosa*), *Rickettsia* (R. *rickettsia*), *Salmonella* (*S. typhi* and *S. typhimurium*), *Shigella* (*S. sonnei* and *S. dysenteriae*), *Staphylococcus* (*S. aureus, S. epidermidis,* and *S. saprophyticus*), *Streptococcus* (*S. agalactiae, S. pneumoniae, S. pyogenes*), *Treponema* (*T. pallidum*), *Ureaplasma* (e.g. *U. urealyticum*), *Vibrio* (e.g. *V. cholerae*), *Yersinia* (e.g. *Y. pestis, Y. enterocolitica,* and *Y. pseudotuberculosis*).

In some embodiments, the pathogenic virus that can be targeted and/or modified by the CRISPR-Cas system(s) and/or component(s) thereof described herein include, but are not limited to, a double-stranded DNA virus, a partly double-stranded DNA virus, a single-stranded DNA virus, a positive single-stranded RNA virus, a negative single-stranded RNA virus, or a double stranded RNA virus. In some embodiments, the pathogenic virus can be from the family Adenoviridae (e.g. Adenovirus), Herpesviridae (e.g. Herpes simplex, type 1, Herpes simplex, type 2, Varicella-zoster virus, Epstein-Barr virus, Human cytomegalovirus, Human herpesvirus, type 8), Papillomaviridae (e.g. Human papillomavirus), Polyomaviridae (e.g. BK virus, JC virus), Poxviridae (e.g. smallpox), Hepadnaviridae (e.g. Hepatitis B), Parvoviridae (e.g. Parvovirus B19), Astroviridae (e.g. Human astrovirus), Caliciviridae (e.g. Norwalk virus), Picornaviridae (e.g. coxsackievirus, hepatitis A virus, poliovirus, rhinovirus), Coronaviridae (e.g. Severe acute respiratory syndrome-related coronavirus, strains: Severe acute respiratory syndrome virus, Severe acute respiratory syndrome coronavirus 2 (COVID-19)), Flaviviridae (e.g. Hepatitis C virus, yellow fever virus, dengue virus, West Nile virus, TBE virus), Togaviridae (e.g. Rubella virus), Hepeviridae (e.g. Hepatitis E virus), Retroviridae (Human immunodeficiency virus (HIV)), Orthomyxoviridae (e.g. Influenza virus), Arenaviridae (e.g. Lassa virus), Bunyaviridae (e.g. Crimean-Congo hemorrhagic fever virus, Hantaan virus), Filoviridae (e.g. Ebola virus and Marburg virus), Paramyxoviridae (e.g. Measles virus, Mumps virus, Parainfluenza virus, Respiratory syncytial virus), Rhabdoviridae (Rabies virus), Hepatitis D virus, Reoviridae (e.g. Rotavirus, Orbivirus, Coltivirus, Banna virus).

In some embodiments, the pathogenic fungi that can be targeted and/or modified by the CRISPR-Cas system(s) and/or component(s) thereof described herein include, but are not limited to, those of the genus *Candida* (e.g. *C. albicans*), *Aspergillus* (e.g. *A. fumigatus, A. flavus, A. clavatus*), *Cryptococcus* (e.g. *C. neoformans, C. gattii*), *Histoplasma* (*H. capsulatum*), *Pneumocystis* (e.g. *P. jirovecii*), *Stachybotrys* (e.g. *S. chartarum*).

In some embodiments, the pathogenic parasites that can be targeted and/or modified by the CRISPR-Cas system(s) and/or component(s) thereof described herein include, but are not limited to, protozoa, helminths, and ectoparasites. In some embodiments, the pathogenic protozoa that can be targeted and/or modified by the CRISPR-Cas system(s) and/or component(s) thereof described herein include, but are not limited to, those from the groups *Sarcodina* (e.g. ameba such as *Entamoeba*), *Mastigophora* (e.g. flagellates such as *Giardia* and *Leishmania*), *Ciliophora* (e.g. ciliates such as *Balantidium*), and sporozoa (e.g. *plasmodium* and *cryptosporidium*). In some embodiments, the pathogenic helminths that can be targeted and/or modified by the CRISPR-Cas system(s) and/or component(s) thereof described herein include, but are not limited to, flatworms (platyhelminths), thorny-headed worms (acanthocephalans), and roundworms (nematodes). In some embodiments, the pathogenic ectoparasites that can be targeted and/or modified by the CRISPR-Cas system(s) and/or component(s) thereof described herein include, but are not limited to, ticks, fleas, lice, and mites.

In some embodiments, the pathogenic parasite that can be targeted and/or modified by the CRISPR-Cas system(s) and/or component(s) thereof described herein include, but are not limited to, *Acanthamoeba* spp., *Balamuthia mandrillaris, Babesiosis* spp. (e.g. *Babesia B. divergens, B. bigemina, B. equi, B. microfti, B. duncani*), *Balantidiasis* spp. (e.g. *Balantidium coli*), *Blastocystis* spp., *Cryptosporidium* spp., *Cyclosporiasis* spp. (e.g. *Cyclospora cayetanensis*), *Dientamoebiasis* spp. (e.g. *Dientamoeba fragilis*), *Amoebiasis* spp. (e.g. *Entamoeba histolytica*), *Giardiasis* spp. (e.g. *Giardia lamblia*), *Isosporiasis* spp. (e.g. *Isospora belli*), *Leishmania* spp., *Naegleria* spp. (e.g. *Naegleria fowleri*), *Plasmodium* spp. (e.g. *Plasmodium falciparum, Plasmodium vivax, Plasmodium ovale curtisi, Plasmodium ovale wallikeri, Plasmodium malariae, Plasmodium knowlesi*), *Rhinosporidiosis* spp. (e.g. *Rhinosporidium seeberi*), *Sarcocystosis* spp. (e.g. *Sarcocystis bovihominis, Sarcocystis suihominis*), *Toxoplasma* spp. (e.g. *Toxoplasma gondii*), *Trichomonas* spp. (e.g. *Trichomonas vaginalis*), *Trypanosoma* spp. (e.g. *Trypanosoma brucei*), *Trypanosoma* spp. (e.g. *Trypanosoma cruzi*), Tapeworm (e.g. *Cestoda, Taenia multiceps, Taenia saginata, Taenia solium*), *Diphyllobothrium latum* spp., *Echinococcus* spp. (e.g. *Echinococcus granulosus, Echinococcus multilocularis, E. vogeli, E. oligarthrus*), *Hymenolepis* spp. (e.g. *Hymenolepis nana, Hymenolepis diminuta*), *Bertiella* spp. (e.g. *Bertiella mucronata, Bertiella studeri*), *Spirometra* (e.g. *Spirometra erinaceieuropaei*), *Clonorchis* spp. (e.g. *Clonorchis sinensis; Clonorchis viverrini*), *Dicrocoelium* spp. (e.g. *Dicrocoelium dendriticum*), *Fasciola* spp. (e.g. *Fasciola hepatica, Fasciola gigantica*), *Fasciolopsis* spp. (e.g. *Fasciolopsis buski*), *Metagonimus* spp. (e.g. *Metagonimus yokogawai*), *Metorchis* spp. (e.g. *Metorchis conjunctus*), *Opisthorchis* spp. (e.g. *Opisthorchis viverrini, Opisthorchis felineus*), *Clonorchis* spp. (e.g. *Clonorchis sinensis*), *Paragonimus* spp. (e.g. *Paragonimus westermani; Paragonimus africanus; Paragonimus caliensis; Paragonimus kellicotti; Paragonimus skrjabini; Paragonimus uterobilateralis*), *Schistosoma* sp., *Schistosoma* spp. (e.g. *Schistosoma mansoni, Schistosoma haematobium, Schistosoma japonicum, Schistosoma mekongi,* and *Schistosoma intercalatum*), *Echinostoma* spp. (e.g. *E. echinatum*), *Trichobilharzia* spp. (e.g. *Trichobilharzia regenti*), *Ancylostoma* spp. (e.g. *Ancylostoma duodenale*), *Necator* spp. (e.g. *Necator americanus*), *Angiostrongylus* spp., *Anisakis* spp., *Ascaris* spp. (e.g. *Ascaris lumbricoides*), *Baylisascaris* spp. (e.g. *Baylisascaris procyonis*), *Brugia* spp. (e.g. *Brugia malayi, Brugia timori*), *Dioctophyme* spp. (e.g. *Dioctophyme renale*), *Dracunculus* spp. (e.g. *Dracunculus medinensis*), *Enterobius* spp. (e.g. *Enterobius vermicularis, Enterobius gregorii*), *Gnathostoma* spp. (e.g. *Gnathostoma spinigerum, Gnathostoma hispidum*), *Halicephalobus* spp. (e.g. *Halicephalobus gingivalis*), *Loa loa* spp. (e.g. *Loa loa* filaria), *Mansonella* spp. (e.g. *Mansonella streptocerca*), *Onchocerca* spp. (e.g. *Onchocerca volvulus*), *Strongyloides* spp. (e.g. *Strongyloides stercoralis*), *Thelazia* spp. (e.g. *Thelazia californien-* sis, *Thelazia callipaeda*), *Toxocara* spp. (e.g. *Toxocara canis, Toxocara cati,* Toxascaris leonine), *Trichinella* spp. (e.g. *Trichinella spiralis, Trichinella britovi, Trichinella nelsoni, Trichinella nativa*), *Trichuris* spp. (e.g. *Trichuris trichiura, Trichuris vulpis*), *Wuchereria* spp. (e.g. *Wuchereria bancrofti*), *Dermatobia* spp. (e.g. *Dermatobia hominis*), *Tunga* spp. (e.g. *Tunga penetrans*), *Cochliomyia* spp. (e.g. *Cochliomyia hominivorax*), *Linguatula* spp. (e.g. *Linguatula serrata*), *Archiacanthocephala* sp., *Moniliformis* sp. (e.g. *Moniliformis moniliformis*), *Pediculus* spp. (e.g. *Pediculus humanus capitis, Pediculus humanus humanus*), *Pthirus* spp. (e.g. *Pthirus pubis*), *Arachnida* spp. (e.g. *Trombiculidae, Ixodidae, Argaside*), *Siphonaptera* spp. (e.g. *Siphonaptera: Pulicinae*), *Cimicidae* spp. (e.g. *Cimex lectularius* and *Cimex hemipterus*), *Diptera* spp., *Demodex* spp. (e.g. *Demodex folliculorum/brevis/canis*), *Sarcoptes* spp. (e.g. *Sarcoptes scabiei*), *Dermanyssus* spp. (e.g. *Dermanyssus gallinae*), *Ornithonyssus* spp. (e.g. *Ornithonyssus sylviarum, Ornithonyssus bursa, Ornithonyssus bacoti*), *Laelaps* spp. (e.g. *Laelaps echidnina*), *Liponyssoides* spp. (e.g. *Liponyssoides sanguineus*).

In some embodiments the gene targets can be any of those as set forth in Table 1 of Strich and Chertow. 2019. J. Clin. Microbio. 57:4 e01307-18, which is incorporated herein as if expressed in its entirety herein.

In some embodiments, the method can include delivering a CRISPR-Cas system and/or component thereof to a pathogenic organism described herein, allowing the CRISPR-Cas system and/or component thereof to specifically bind and modify one or more targets in the pathogenic organism, whereby the modification kills, inhibits, reduces the pathogenicity of the pathogenic organism, or otherwise renders the pathogenic organism non-pathogenic. In some embodiments, delivery of the CRISPR-Cas system occurs in vivo (i.e. in the subject being treated). In some embodiments occurs by an intermediary, such as microorganism or phage that is non-pathogenic to the subject but is capable of transferring polynucleotides and/or infecting the pathogenic microorganism. In some embodiments, the intermediary microorganism can be an engineered bacteria, virus, or phage that contains the CRISPR-Cas system(s) and/or component(s) thereof and/or CRISPR-Cas vectors and/or vector systems. The method can include administering an intermediary microorganism containing the CRISPR-Cas system(s) and/or component(s) thereof and/or CRISPR-Cas vectors and/or vector systems to the subject to be treated. The intermediary microorganism can then produce the CRISPR-system and/or component thereof or transfer a CRISPR-Cas system polynucleotide to the pathogenic organism. In embodiments, where the CRISPR-system and/or component thereof, vector, or vector system is transferred to the pathogenic microorganism, the CRISPR-Cas system or component thereof is then produced in the pathogenic microorganism and modifies the pathogenic microorganism such that it is less virulent, killed, inhibited, or is otherwise rendered incapable of causing disease and/or infecting and/or replicating in a host or cell thereof.

In some embodiments, where the pathogenic microorganism inserts its genetic material into the host cell's genome (e.g. a virus), the CRISPR-Cas system can be designed such that it modifies the host cell's genome such that the viral DNA or cDNA cannot be replicated by the host cell's machinery into a functional virus. In some embodiments, where the pathogenic microorganism inserts its genetic material into the host cell's genome (e.g. a virus), the CRISPR-Cas system can be designed such that it modifies the host cell's genome such that the viral DNA or cDNA is deleted from the host cell's genome.

It will be appreciated that inhibiting or killing the pathogenic microorganism, the disease and/or condition that its infection causes in the subject can be treated or prevented. Thus, also provided herein are methods of treating and/or preventing one or more diseases or symptoms thereof caused by any one or more pathogenic microorganisms, such as any of those described herein.

Mitochondrial Diseases

Some of the most challenging mitochondrial disorders arise from mutations in mitochondrial DNA (mtDNA), a high copy number genome that is maternally inherited. In some embodiments, mtDNA mutations can be modified using a CRISPR-Cas system described herein. In some embodiments, the mitochondrial disease that can be diagnosed, prognosed, treated, and/or prevented can be MELAS (mitochondrial myopathy encephalopathy, and lactic acidosis and stroke-like episodes), CPEO/PEO (chronic progressive external ophthalmoplegia syndrome/progressive external ophthalmoplegia), KSS (Kearns-Sayre syndrome), MIDD (maternally inherited diabetes and deafness), MERRF (myoclonic epilepsy associated with ragged red fibers), NIDDM (noninsulin-dependent diabetes mellitus), LHON (Leber hereditary optic neuropathy), LS (Leigh Syndrome) an aminoglycoside induced hearing disorder, NARP (neuropathy, ataxia, and pigmentary retinopathy), Extrapyramidal disorder with akinesia-rigidity, psychosis and SNHL, Nonsyndromic hearing loss a cardiomyopathy, an encephalomyopathy, Pearson's syndrome, a disease identified as being caused or attributed to a mtDNA mutation set forth at mitomap.org, or a combination thereof.

In some embodiments, the mtDNA of a subject can be modified in vivo or ex vivo. In some embodiments, where the mtDNA is modified ex vivo, after modification the cells containing the modified mitochondria can be administered back to the subject. In some embodiments, the CRISPR-Cas system or component thereof can be capable of correcting an mtDNA mutation such as any one or more of those that can be found at mitomap.org.

In some embodiments, at least one of the one or more mtDNA mutations is selected from the group consisting of: A3243G, C3256T, T3271C, G1019A, A1304T, A15533G, C1494T, C4467A, T1658C, G12315A, A3421G, A8344G, T8356C, G8363A, A13042T, T3200C, G3242A, A3252G, T3264C, G3316A, T3394C, T14577C, A4833G, G3460A, G9804A, G11778A, G14459A, A14484G, G15257A, T8993C, T8993G, G10197A, G13513A, T1095C, C1494T, A1555G, G1541A, C1634T, A3260G, A4269G, T7587C, A8296G, A8348G, G8363A, T9957C, T9997C, G12192A, C12297T, A14484G, G15059A, duplication of CCCCCTCCCC-tandem repeats at positions 305-314 and/or 956-965, deletion at positions from 8,469-13,447, 4,308-14, 874, and/or 4,398-14,822, 961ins/delC, the mitochondrial common deletion (e.g. mtDNA 4,977 bp deletion), and combinations thereof.

In some embodiments, the mitochondrial mutation can be any mutation as set forth in or as identified by use of one or more bioinformatic tools available at Mitomap available at mitomap.org. Such tools include, but are not limited to, "Variant Search, aka Market Finder", Find Sequences for Any Haplogroup, aka "Sequence Finder", "Variant Info", "POLG Pathogenicity Prediction Server", "MITOMASTER", "Allele Search", "Sequence and Variant Downloads", "Data Downloads". MitoMap contains reports of mutations in mtDNA that can be associated with disease and maintains a database of reported mitochondrial DNA Base Substitution Diseases: rRNA/tRNA mutations.

In some embodiments, the method includes delivering a CRISPR-Cas system and/or a component thereof to a cell, and more specifically one or more mitochondria in a cell, allowing the CRISPR-Cas system and/or component thereof to modify one or more target polynucleotides in the cell, and more specifically one or more mitochondria in the cell. The target polynucleotides can correspond to a mutation in the mtDNA, such as any one or more of those described herein. In some embodiments, the modification can alter a function of the mitochondria such that the mitochondria functions normally or at least is/are less dysfunctional as compared to an unmodified mitochondria. Modification can occur in vivo or ex vivo. Where modification is performed ex vivo, cells containing modified mitochondria can be administered to a subject in need thereof in an autologous or allogenic manner.

Microbiome Modification

Microbiomes play important roles in health and disease. For example, the gut microbiome can play a role in health by controlling digestion, preventing growth of pathogenic microorganisms and have been suggested to influence mood and emotion and other neurologic and brain functions via what is termed in the art as the brain-gut axis. Imbalanced microbiomes can promote disease and are suggested to contribute to weight gain, unregulated blood sugar, high cholesterol, cancer, and other disorders. A healthy microbiome has a series of joint characteristics that can be distinguished from non-healthy individuals. Thus, detection and identification of the disease-associated microbiome can be used to diagnose and detect disease in an individual. The CRISPR-Cas systems and components thereof can be used to screen the microbiome cell population and be used to identify a disease associated microbiome. Cell screening methods utilizing CRISPR-Cas systems and components thereof are described elsewhere herein and can be applied to screening a microbiome, such as a gut, skin, vagina, nasal cavity, and/or oral microbiome, of a subject.

In some embodiments, the microbe population of a microbiome in a subject can be modified using a CRISPR-Cas system and/or component thereof described herein. In some embodiments, the CRISPR-Cas system and/or component thereof can be used to identify and select one or more cell types in the microbiome and remove them from the microbiome population. In some embodiments the CRISPR-Cas system can modify, in vitro or ex vivo, a bacterium of a genus, species, and/or strain suitable for introduction into a microbiome of a subject. After modification the modified bacterium can be administered to the subject via any suitable method for its introduction into a microbiome of a subject. Exemplary methods of selecting cells using a CRISPR-Cas system and/or component thereof are described elsewhere herein. In this way the make-up or microorganism profile of the microbiome can be altered. In some embodiments, the alteration causes a change from a diseased microbiome composition to a healthy microbiome composition. In this way the ratio of one type or species of microorganism to another can be modified, such as going from a diseased ratio to a healthy ratio. In some embodiments, the cells selected are pathogenic microorganisms.

In some embodiments, the CRISPR-Cas systems described herein can be used to modify a polynucleotide in a microorganism of a microbiome in a subject. In some embodiments, the microorganism is a pathogenic microorganism. In some embodiments, the microorganism is a commensal and non-pathogenic microorganism. Methods of modifying polynucleotides in a cell in the subject are described elsewhere herein and can be applied to these embodiments.

Adoptive Therapy

The CRISPR-Cas systems and components thereof described herein can be used to modify cells for an adoptive cell therapy. It will be appreciated that any cell type can be used for adoptive therapy. In some embodiments, the adoptive therapy is autologous. In some embodiments, the adoptive therapy is allogenic. In general, adoptive therapy involves harvesting a cell from a source (autologous source (i.e. the subject to which the cells will be administered) or allogeneic source. After harvesting, the cells are cultured, optionally expanded (clonally or non-clonally), and modified using a CRISPR-Cas system described elsewhere herein, components thereof, and/or complex thereof. In some embodiments, further cell manipulations, sorting, and/or culturing, etc. are performed). After modification, the modified cells are then administered to the subject in need thereof. Although the exemplary embodiments described herein focus on adoptive therapy using immune cells, it will be appreciated that other cells may be suitable depending on the disease or condition being treated and/or desired outcome as will be appreciated by one of ordinary skill in the art in view of the disclosure herein.

Some embodiments involve the adoptive transfer of immune system cells, such as T cells, specific for selected antigens, such as tumor associated antigens (see Maus et al., 2014, Adoptive Immunotherapy for Cancer or Viruses, Annual Review of Immunology, Vol. 32: 189-225; Rosenberg and Restifo, 2015, Adoptive cell transfer as personalized immunotherapy for human cancer, Science Vol. 348 no. 6230 pp. 62-68; and, Restifo et al., 2015, Adoptive immunotherapy for cancer: harnessing the T cell response. Nat. Rev. Immunol. 12(4): 269-281; and Jenson and Riddell, 2014, Design and implementation of adoptive therapy with chimeric antigen receptor-modified T cells. Immunol Rev. 257(1): 127-144). Various strategies may for example be employed to genetically modify T cells by altering the specificity of the T cell receptor (TCR) for example by introducing new TCR α and β chains with selected peptide specificity (see U.S. Pat. No. 8,697,854; PCT Patent Publications: WO2003020763, WO2004033685, WO2004044004, WO2005114215, WO2006000830, WO2008038002, WO2008039818, WO2004074322, WO2005113595, WO2006125962, WO2013166321, WO2013039889, WO2014018863, WO2014083173; U.S. Pat. No. 8,088,379).

As an alternative to, or addition to, TCR modifications, chimeric antigen receptors (CARs) may be used in order to generate immunoresponsive cells, such as T cells, specific for selected targets, such as malignant cells, with a wide variety of receptor chimera constructs having been described (see U.S. Pat. Nos. 5,843,728; 5,851,828; 5,912,170; 6,004,811; 6,284,240; 6,392,013; 6,410,014; 6,753,162; 8,211,422; and, PCT Publication WO9215322). Alternative CAR constructs may be characterized as belonging to successive generations. First-generation CARs typically consist of a single-chain variable fragment of an antibody specific for an antigen, for example comprising a VL linked to a VH of a specific antibody, linked by a flexible linker, for example by a CD8α hinge domain and a CD8α transmembrane domain, to the transmembrane and intracellular signaling domains of either CD3ζ or FcRγ (scFv-CD3ζ or scFv-FcRγ; see U.S. Pat. Nos. 7,741,465; 5,912,172; 5,906,936). Second-generation CARs incorporate the intracellular domains of one or more costimulatory molecules, such as CD28, OX40

(CD134), or 4-1BB (CD137) within the endodomain (for example scFv-CD28/OX40/4-1BB-CD3ζ; see U.S. Pat. Nos. 8,911,993; 8,916,381; 8,975,071; 9,101,584; 9,102,760; 9,102,761). Third-generation CARs include a combination of costimulatory endodomains, such a CD3ζ-chain, CD97, GDI la-CD18, CD2, ICOS, CD27, CD154, CDS, OX40, 4-1BB, or CD28 signaling domains (for example scFv-CD28-4-1BB-CD3ζ or scFv-CD28-OX40-CD3ζ; see U.S. Pat. Nos. 8,906,682; 8,399,645; 5,686,281; PCT Publication No. WO2014134165; PCT Publication No. WO2012079000). Alternatively, co-stimulation may be orchestrated by expressing CARs in antigen-specific T cells, chosen so as to be activated and expanded following engagement of their native αβTCR, for example by antigen on professional antigen-presenting cells, with attendant co-stimulation. In addition, additional engineered receptors may be provided on the immunoresponsive cells, for example to improve targeting of a T-cell attack and/or minimize side effects.

Alternative techniques may be used to transform target immunoresponsive cells, such as protoplast fusion, lipofection, transfection or electroporation. A wide variety of vectors may be used, such as retroviral vectors, lentiviral vectors, adenoviral vectors, adeno-associated viral vectors, plasmids or transposons, such as a Sleeping Beauty transposon (see U.S. Pat. Nos. 6,489,458; 7,148,203; 7,160,682; 7,985,739; 8,227,432), may be used to introduce CARs, for example using 2nd generation antigen-specific CARs signaling through CD3ζ and either CD28 or CD137. Viral vectors may for example include vectors based on HIV, SV40, EBV, HSV or BPV.

Cells that are targeted for transformation may for example include T cells, Natural Killer (NK) cells, cytotoxic T lymphocytes (CTL), regulatory T cells, human embryonic stem cells, tumor-infiltrating lymphocytes (TIL) or a pluripotent stem cell from which lymphoid cells may be differentiated. T cells expressing a desired CAR may for example be selected through co-culture with γ-irradiated activating and propagating cells (AaPC), which co-express the cancer antigen and co-stimulatory molecules. The engineered CAR T-cells may be expanded, for example by co-culture on AaPC in presence of soluble factors, such as IL-2 and IL-21. This expansion may for example be carried out so as to provide memory CAR+ T cells (which may for example be assayed by non-enzymatic digital array and/or multi-panel flow cytometry). In this way, CAR T cells may be provided that have specific cytotoxic activity against antigen-bearing tumors (optionally in conjunction with production of desired chemokines such as interferon-γ). CAR T cells of this kind may for example be used in animal models, for example to threat tumor xenografts.

Approaches such as the foregoing may be adapted to provide methods of treating and/or increasing survival of a subject having a disease, such as a neoplasia, for example by administering an effective amount of an immunoresponsive cell comprising an antigen recognizing receptor that binds a selected antigen, wherein the binding activates the immunoreponsive cell, thereby treating or preventing the disease (such as a neoplasia, a pathogen infection, an autoimmune disorder, or an allogeneic transplant reaction). Dosing in CAR T cell therapies may for example involve administration of from 106 to 109 cells/kg, with or without a course of lymphodepletion, for example with cyclophosphamide.

In some embodiments, the treatment is administrated into patients undergoing an immunosuppressive treatment. The cells or population of cells can be made resistant to at least one immunosuppressive agent due to the inactivation of a gene encoding a receptor for such immunosuppressive agent. Not being bound by a theory, the immunosuppressive treatment should help the selection and expansion of the immunoresponsive or T cells according to the invention within the patient.

The administration of the cells or population of cells according to the present invention may be carried out in any convenient manner, including by aerosol inhalation, injection, ingestion, transfusion, implantation or transplantation. The cells or population of cells may be administered to a patient subcutaneously, intradermally, intratumorally, intranodally, intramedullary, intramuscularly, by intravenous or intralymphatic injection, or intraperitoneally. In one embodiment, the cell compositions of the present invention are preferably administered by intravenous injection.

The administration of the cells or population of cells can consist of the administration of 104-109 cells per kg body weight, preferably 105 to 106 cells/kg body weight including all integer values of cell numbers within those ranges. Dosing in CAR T cell therapies may for example involve administration of from 106 to 109 cells/kg, with or without a course of lymphodepletion, for example with cyclophosphamide. The cells or population of cells can be administrated in one or more doses. In another embodiment, the effective amount of cells are administrated as a single dose. In another embodiment, the effective amount of cells are administrated as more than one dose over a period time. Timing of administration is within the judgment of managing physician and depends on the clinical condition of the patient. The cells or population of cells may be obtained from any source, such as a blood bank or a donor. While individual needs vary, determination of optimal ranges of effective amounts of a given cell type for a particular disease or conditions are within the skill of one in the art. An effective amount means an amount which provides a therapeutic or prophylactic benefit. The dosage administrated will be dependent upon the age, health and weight of the recipient, kind of concurrent treatment, if any, frequency of treatment and the nature of the effect desired.

In another embodiment, the effective amount of cells or composition comprising those cells are administrated parenterally. The administration can be an intravenous administration. The administration can be directly done by injection within a tumor.

To guard against possible adverse reactions, engineered immunoresponsive cells may be equipped with a transgenic safety switch, in the form of a transgene that renders the cells vulnerable to exposure to a specific signal. For example, the herpes simplex viral thymidine kinase (TK) gene may be used in this way, for example by introduction into allogeneic T lymphocytes used as donor lymphocyte infusions following stem cell transplantation (Greco, et al., Improving the safety of cell therapy with the TK-suicide gene. Front. Pharmacol. 2015; 6: 95). In such cells, administration of a nucleoside prodrug such as ganciclovir or acyclovir causes cell death. Alternative safety switch constructs include inducible caspase 9, for example triggered by administration of a small-molecule dimerizer that brings together two nonfunctional icasp9 molecules to form the active enzyme. A wide variety of alternative approaches to implementing cellular proliferation controls have been described (see U.S. Patent Publication No. 20130071414; PCT Patent Publication No. WO2011146862; PCT Patent Publication WO2014011987; PCT Patent Publication WO2013040371; Zhou et al. BLOOD, 2014, 123/25:3895-3905; Di Stasi et al., The New England Journal of Medicine 2011; 365:1673-

1683; Sadelain M, The New England Journal of Medicine 2011; 365:1735-173; Ramos et al., Stem Cells 28(6):1107-15 (2010)).

In a further refinement of adoptive therapies, genome editing with a CRISPR-Cas system as described herein may be used to tailor immunoresponsive cells to alternative implementations, for example providing edited CAR T cells (see Poirot et al., 2015, Multiplex genome edited T-cell manufacturing platform for "off-the-shelf" adoptive T-cell immunotherapies, Cancer Res 75 (18): 3853). For example, immunoresponsive cells may be edited to delete expression of some or all of the class of HLA type II and/or type I molecules, or to knockout selected genes that may inhibit the desired immune response, such as the PD1 gene.

Cells may be edited using any CRISPR system and method of use thereof as described herein. CRISPR systems may be delivered to an immune cell by any method described herein. In preferred embodiments, cells are edited ex vivo and transferred to a subject in need thereof. Immunoresponsive cells, CAR T cells or any cells used for adoptive cell transfer may be edited. Editing may be performed to eliminate potential alloreactive T-cell receptors (TCR), disrupt the target of a chemotherapeutic agent, block an immune checkpoint, activate a T cell, and/or increase the differentiation and/or proliferation of functionally exhausted or dysfunctional CD8+ T-cells (see PCT Patent Publications: WO2013176915, WO2014059173, WO2014172606, WO2014184744, and WO2014191128). Editing may result in inactivation of a gene.

T cell receptors (TCR) are cell surface receptors that participate in the activation of T cells in response to the presentation of antigen. The TCR is generally made from two chains, α and β, which assemble to form a heterodimer and associates with the CD3-transducing subunits to form the T cell receptor complex present on the cell surface. Each α and β chain of the TCR consists of an immunoglobulin-like N-terminal variable (V) and constant (C) region, a hydrophobic transmembrane domain, and a short cytoplasmic region. As for immunoglobulin molecules, the variable region of the α and β chains are generated by V(D)J recombination, creating a large diversity of antigen specificities within the population of T cells. However, in contrast to immunoglobulins that recognize intact antigen, T cells are activated by processed peptide fragments in association with an MHC molecule, introducing an extra dimension to antigen recognition by T cells, known as MHC restriction. Recognition of MHC disparities between the donor and recipient through the T cell receptor leads to T cell proliferation and the potential development of graft versus host disease (GVHD). The inactivation of TCRα or TCRβ can result in the elimination of the TCR from the surface of T cells preventing recognition of alloantigen and thus GVHD. However, TCR disruption generally results in the elimination of the CD3 signaling component and alters the means of further T cell expansion.

Allogeneic cells are rapidly rejected by the host immune system. It has been demonstrated that allogeneic leukocytes present in non-irradiated blood products will persist for no more than 5 to 6 days (Boni, Muranski et al. 2008 Blood 1; 112(12):4746-54). Thus, to prevent rejection of allogeneic cells, the host's immune system usually has to be suppressed to some extent. However, in the case of adoptive cell transfer the use of immunosuppressive drugs also have a detrimental effect on the introduced therapeutic T cells. Therefore, to effectively use an adoptive immunotherapy approach in these conditions, the introduced cells would need to be resistant to the immunosuppressive treatment. Thus, in a particular embodiment, the present invention further comprises a step of modifying T cells to make them resistant to an immunosuppressive agent, preferably by inactivating at least one gene encoding a target for an immunosuppressive agent. An immunosuppressive agent is an agent that suppresses immune function by one of several mechanisms of action. An immunosuppressive agent can be, but is not limited to a calcineurin inhibitor, a target of rapamycin, an interleukin-2 receptor α-chain blocker, an inhibitor of inosine monophosphate dehydrogenase, an inhibitor of dihydrofolic acid reductase, a corticosteroid or an immunosuppressive antimetabolite. The present invention allows conferring immunosuppressive resistance to T cells for immunotherapy by inactivating the target of the immunosuppressive agent in T cells. As non-limiting examples, targets for an immunosuppressive agent can be a receptor for an immunosuppressive agent such as: CD52, glucocorticoid receptor (GR), a FKBP family gene member and a cyclophilin family gene member.

Immune checkpoints are inhibitory pathways that slow down or stop immune reactions and prevent excessive tissue damage from uncontrolled activity of immune cells. In certain embodiments, the immune checkpoint targeted is the programmed death-1 (PD-1 or CD279) gene (PDCD1). In other embodiments, the immune checkpoint targeted is cytotoxic T-lymphocyte-associated antigen (CTLA-4). In additional embodiments, the immune checkpoint targeted is another member of the CD28 and CTLA4 Ig superfamily such as BTLA, LAG3, ICOS, PDL1 or KIR. In further additional embodiments, the immune checkpoint targeted is a member of the TNFR superfamily such as CD40, OX40, CD137, GITR, CD27 or TIM-3.

Additional immune checkpoints include Src homology 2 domain-containing protein tyrosine phosphatase 1 (SHP-1) (Watson H A, et al., SHP-1: the next checkpoint target for cancer immunotherapy? Biochem Soc Trans. 2016 Apr. 15; 44(2):356-62). SHP-1 is a widely expressed inhibitory protein tyrosine phosphatase (PTP). In T-cells, it is a negative regulator of antigen-dependent activation and proliferation. It is a cytosolic protein, and therefore not amenable to antibody-mediated therapies, but its role in activation and proliferation makes it an attractive target for genetic manipulation in adoptive transfer strategies, such as chimeric antigen receptor (CAR) T cells. Immune checkpoints may also include T cell immunoreceptor with Ig and ITIM domains (TIGIT/Vstm3/WUCAM/VSIG9) and VISTA (Le Mercier I, et al., (2015) Beyond CTLA-4 and PD-1, the generation Z of negative checkpoint regulators. Front. Immunol. 6:418).

International Patent Publication No. WO2014172606 relates to the use of MT1 and/or MT1 inhibitors to increase proliferation and/or activity of exhausted CD8+ T-cells and to decrease CD8+ T-cell exhaustion (e.g., decrease functionally exhausted or unresponsive CD8+ immune cells). In certain embodiments, metallothioneins are targeted by gene editing in adoptively transferred T cells.

In certain embodiments, targets of gene editing may be at least one targeted locus involved in the expression of an immune checkpoint protein. Such targets may include, but are not limited to CTLA4, PPP2CA, PPP2CB, PTPN6, PTPN22, PDCD1, ICOS (CD278), PDL1, KIR, LAG3, HAVCR2, BTLA, CD160, TIGIT, CD96, CRTAM, LAIR1, SIGLEC7, SIGLEC9, CD244 (2B4), TNFRSF10B, TNFRSF10A, CASP8, CASP10, CASP3, CASP6, CASP7, FADD, FAS, TGFBRII, TGFBRI, SMAD2, SMAD3, SMAD4, SMAD10, SKI, SKIL, TGIF1, IL10RA, IL10RB, HMOX2, IL6R, IL6ST, EIF2AK4, CSK, PAG1, SIT1, FOXP3, PRDM1, BATF, VISTA, GUCY1A2, GUCY1A3, GUCY1B2, GUCY1B3, MT1, MT2, CD40, OX40, CD137, GITR, CD27, SHP-1 or TIM-3. In preferred embodiments, the gene locus involved in the expression of PD-1 or CTLA-4 genes is targeted. In other preferred embodiments, combinations of genes are targeted, such as but not limited to PD-1 and TIGIT.

In other embodiments, at least two genes are edited. Pairs of genes may include, but are not limited to PD1 and TCRα, PD1 and TCRβ, CTLA-4 and TCRα, CTLA-4 and TCRβ, LAG3 and TCRα, LAG3 and TCRβ, Tim3 and TCRα, Tim3 and TCRβ, BTLA and TCRα, BTLA and TCRβ, BY55 and TCRα, BY55 and TCRβ, TIGIT and TCRα, TIGIT and TCRβ, B7H5 and TCRα, B7H5 and TCRβ, LAIR1 and TCRα, LAIR1 and TCRβ, SIGLEC10 and TCRα, SIGLEC10 and TCRβ, 2B4 and TCRα, 2B4 and TCRβ.

Whether prior to or after genetic modification of the T cells, the T cells can be activated and expanded generally using methods as described, for example, in U.S. Pat. Nos. 6,352,694; 6,534,055; 6,905,680; 5,858,358; 6,887,466; 6,905,681; 7,144,575; 7,232,566; 7,175,843; 5,883,223; 6,905,874; 6,797,514; 6,867,041; and 7,572,631. T cells can be expanded in vitro or in vivo.

The practice of the present invention employs, unless otherwise indicated, conventional techniques of immunology, biochemistry, chemistry, molecular biology, microbiology, cell biology, genomics and recombinant DNA, which are within the skill of the art. See MOLECULAR CLONING: A LABORATORY MANUAL, 2nd edition (1989) (Sambrook, Fritsch and Maniatis); MOLECULAR CLONING: A LABORATORY MANUAL, 4th edition (2012) (Green and Sambrook); CURRENT PROTOCOLS IN MOLECULAR BIOLOGY (1987) (F. M. Ausubel, et al. eds.); the series METHODS IN ENZYMOLOGY (Academic Press, Inc.); PCR 2: A PRACTICAL APPROACH (1995) (M. J. MacPherson, B. D. Hames and G. R. Taylor eds.); ANTIBODIES, A LABORATORY MANUAL (1988) (Harlow and Lane, eds.); ANTIBODIES A LABORATORY MANUAL, 2nd edition (2013) (E. A. Greenfield ed.); and ANIMAL CELL CULTURE (1987) (R. I. Freshney, ed.).

The practice of the present invention employs, unless otherwise indicated, conventional techniques for generation of genetically modified mice. See Marten H. Hofker and Jan van Deursen, TRANSGENIC MOUSE METHODS AND PROTOCOLS, 2nd edition (2011).

In some embodiments, the invention described herein relates to a method for adoptive immunotherapy, in which T cells are edited ex vivo by CRISPR to modulate at least one gene and subsequently administered to a patient in need thereof. In some embodiments, the CRISPR editing comprising knocking-out or knocking-down the expression of a target gene in the edited T cells. In some embodiments, in addition to modulating the target gene, the T cells are also edited ex vivo by CRISPR to (1) knock-in an exogenous gene encoding a chimeric antigen receptor (CAR) or a T-cell receptor (TCR), (2) knock-out or knock-down expression of an immune checkpoint receptor, (3) knock-out or knock-down expression of an endogenous TCR, (4) knock-out or knock-down expression of a human leukocyte antigen class I (HLA-I) proteins, and/or (5) knock-out or knock-down expression of an endogenous gene encoding an antigen targeted by an exogenous CAR or TCR.

In some embodiments, the T cells are contacted ex vivo with an adeno-associated virus (AAV) vector encoding a CRISPR effector protein, and a guide molecule comprising a guide sequence hybridizable to a target sequence, a tracr mate sequence, and a tracr sequence hybridizable to the tracr mate sequence. In some embodiments, the T cells are contacted ex vivo (e.g., by electroporation) with a ribonucleoprotein (RNP) comprising a CRISPR effector protein complexed with a guide molecule, wherein the guide molecule comprising a guide sequence hybridizable to a target sequence, a tracr mate sequence, and a tracr sequence hybridizable to the tracr mate sequence. See Rupp et al., Scientific Reports 7:737 (2017); Liu et al., Cell Research 27:154-157 (2017). In some embodiments, the T cells are contacted ex vivo (e.g., by electroporation) with an mRNA encoding a CRISPR effector protein, and a guide molecule comprising a guide sequence hybridizable to a target sequence, a tracr mate sequence, and a tracr sequence hybridizable to the tracr mate sequence. See Eyquem et al., Nature 543:113-117 (2017). In some embodiments, the T cells are not contacted ex vivo with a lentivirus or retrovirus vector.

In some embodiments, the method comprises editing T cells ex vivo by CRISPR to knock-in an exogenous gene encoding a CAR, thereby allowing the edited T cells to recognize cancer cells based on the expression of specific proteins located on the cell surface. In some embodiments, T cells are edited ex vivo by CRISPR to knock-in an exogenous gene encoding a TCR, thereby allowing the edited T cells to recognize proteins derived from either the surface or inside of the cancer cells. In some embodiments, the method comprising providing an exogenous CAR-encoding or TCR-encoding sequence as a donor sequence, which can be integrated by homology-directed repair (HDR) into a genomic locus targeted by a CRISPR guide sequence. In some embodiments, targeting the exogenous CAR or TCR to an endogenous TCR α constant (TRAC) locus can reduce tonic CAR signaling and facilitate effective internalization and re-expression of the CAR following single or repeated exposure to antigen, thereby delaying effector T-cell differentiation and exhaustion. See Eyquem et al., Nature 543:113-117 (2017).

In some embodiments, the method comprises editing T cells ex vivo by CRISPR to block one or more immune checkpoint receptors to reduce immunosuppression by cancer cells. In some embodiments, T cells are edited ex vivo by CRISPR to knock-out or knock-down an endogenous gene involved in the programmed death-1 (PD-1) signaling pathway, such as PD-1 and PD-L1. In some embodiments, T cells are edited ex vivo by CRISPR to mutate the Pdcd1 locus or the CD274 locus. In some embodiments, T cells are edited ex vivo by CRISPR using one or more guide sequences targeting the first exon of PD-1. See Rupp et al., Scientific Reports 7:737 (2017); Liu et al., Cell Research 27:154-157 (2017).

In some embodiments, the method comprises editing T cells ex vivo by CRISPR to eliminate potential alloreactive TCRs to allow allogeneic adoptive transfer. In some embodiments, T cells are edited ex vivo by CRISPR to knock-out or knock-down an endogenous gene encoding a TCR (e.g., an αβ TCR) to avoid graft-versus-host-disease (GVHD). In some embodiments, T cells are edited ex vivo by CRISPR to mutate the TRAC locus. In some embodiments, T cells are edited ex vivo by CRISPR using one or more guide sequences targeting the first exon of TRAC. See Liu et al., Cell Research 27:154-157 (2017). In some embodiments, the method comprises use of CRISPR to knock-in an exogenous gene encoding a CAR or a TCR into the TRAC locus, while simultaneously knocking-out the endogenous TCR (e.g., with a donor sequence encoding a self-cleaving P2A peptide following the CAR cDNA). See Eyquem et al., Nature 543:113-117 (2017). In some embodiments, the exogenous gene comprises a promoter-less CAR-encoding or TCR-encoding sequence which is inserted operably downstream of an endogenous TCR promoter.

In some embodiments, the method comprises editing T cells ex vivo by CRISPR to knock-out or knock-down an endogenous gene encoding an HLA-I protein to minimize immunogenicity of the edited T cells. In some embodiments, T cells are edited ex vivo by CRISPR to mutate the beta-2 microglobulin (B2M) locus. In some embodiments, T cells are edited ex vivo by CRISPR using one or more guide sequences targeting the first exon of B2M. See Liu et al., Cell Research 27:154-157 (2017). In some embodiments, the method comprises use of CRISPR to knock-in an exogenous gene encoding a CAR or a TCR into the B2M locus, while simultaneously knocking-out the endogenous B2M (e.g., with a donor sequence encoding a self-cleaving P2A peptide following the CAR cDNA). See Eyquem et al., Nature 543:113-117 (2017). In some embodiments, the exogenous gene comprises a promoter-less CAR-encoding or TCR-encoding sequence which is inserted operably downstream of an endogenous B2M promoter.

In some embodiments, the method comprises editing T cells ex vivo by CRISPR to knock-out or knock-down an endogenous gene encoding an antigen targeted by an exogenous CAR or TCR. In some embodiments, the T cells are edited ex vivo by CRISPR to knock-out or knock-down the expression of a tumor antigen selected from human telomerase reverse transcriptase (hTERT), survivin, mouse double minute 2 homolog (MDM2), cytochrome P450 1B 1 (CYP1B), HER2/neu, Wilms' tumor gene 1 (WT1), livin, alphafetoprotein (AFP), carcinoembryonic antigen (CEA), mucin 16 (MUC16), MUC1, prostate-specific membrane antigen (PSMA), p53 or cyclin (DI) (see WO2016/011210). In some embodiments, the T cells are edited ex vivo by CRISPR to knock-out or knock-down the expression of an antigen selected from B cell maturation antigen (BCMA), transmembrane activator and CAML Interactor (TACI), or B-cell activating factor receptor (BAFF-R), CD38, CD138, CS-1, CD33, CD26, CD30, CD53, CD92, CD100, CD148, CD150, CD200, CD261, CD262, or CD362 (see WO2017/011804).

Treating and Preventing Diseases Using RNA Editing

In some embodiments, the disease, disorder, and/or condition or symptom thereof can be treated or prevented using an RNA editing system described herein. In some embodiments, the CRISPR-Cas system described herein is an RNA editing system. In some embodiments, treatment or prevention using a CRISPR-Cas RNA editing system described herein can have the advantage of less immunogenicity than a DNA editing CRISPR-Cas system and is not as hindered by limitations on viral vector packaging size. Further, as the effect is transient, the effect can be better controlled over time and can potentially be reversible. Thus, they pose less risk of causing permeant detrimental effects than DNA editing-based preventatives and treatments.

In some of these embodiments, the CRISPR-Cas system contains an ADAR enzyme or effector domain thereof. Such systems are described elsewhere herein. In some embodiments, the CIRSPR-Cas system includes a Cas13 or Cas13d effector.

Any disease involving a dysfunctional RNA molecule, where the dysfunction is the result of a mutation in the RNA sequence can be treated or prevented by modifying its sequence using a CRISPR-Cas system capable of RNA modification described elsewhere herein. In some embodiments, the disease that can be treated or prevented using a CRISPR-Cas system capable of RNA modification can be one or more of those listed in Tables 11 and 12, one or more of those set forth in any of a disease identified as being caused or attributed to a mtDNA mutation set forth at mitomap.org, or a combination thereof. In some embodiments, the coding sequence for the gene involved in the disease is greater than the packaging capacity of a viral vector system, particularly an AAV vector system.

The potential for RNA editing has now been demonstrated in vitro and in vivo for pathogenic mutations in genes related to cystic fibrosis, Duchenne's muscular dystrophy, Hurler's syndrome, and Ornithine transcarbamylase (OTC) deficiency, among others. See e.g. Katrekar et al. Nat. Methods. 2019. 16:239-242; Montieel-Gonzalez et la. 2013. PNAS USA. 110: 18285-18290; Sinnamon et al. Proc. Natl Acad Sci. U.S.A. 2017 114(44):E9395-E9402, pubmed.ncbi.nlm.nih.gov/29078406/; Wettengel et al., Nucleic Acids Res. 2017. 45(5):2797-2808 academic.oup.com/nar/article/45/5/2797/2962177 #google_vignette; Qu et al. BioRxiv. 2019, 605972; and Fry et al, Int. J. Mol. Sci. 2020, 21(3): 777, mdpi.com/1422-0067/21/3/777, which are incorporated by reference as if expressed in their entirety here and the teachings of which can be adapted in view of the description herein to the CRISPR-Cas Systems described herein.

In some embodiments, the disease is an inherited retinal degeneration disease. In some embodiments, gene whose transcript can be modified using a CRISPR-Cas system described herein capable of RNA modification that is associated with inherited retinal degeneration and whose coding sequence is too large for packaging in a single AAV can be ABC4, USH2A, CEP290, MYO7A, EYS, and CDH23.

Models of Diseases and Conditions

In some embodiments, a method of modeling a disease associated with a genomic locus in a eukaryotic organism or a non-human organism includes manipulation of a target sequence within a coding, non-coding or regulatory element of said genomic locus comprising delivering a non-naturally occurring or engineered composition comprising a viral vector system comprising one or more viral vectors operably encoding a composition for expression thereof, wherein the composition comprises particle delivery system or the delivery system or the virus particle of any one of the above embodiments or the cell of any one of the above embodiment.

In some embodiments, the invention provides a method of generating a model eukaryotic cell that can include one or more mutated disease genes and/or infectious microorganisms. In some embodiments, a disease gene is any gene associated an increase in the risk of having or developing a disease. In some embodiments, the method includes (a) introducing one or more vectors into a eukaryotic cell, wherein the one or more vectors comprise a CRISPR-Cas system and/or component thereof and/or a CRISPR-Cas vector or vector system that is capable of driving expression of a CRISPR-Cas system and/or component thereof including, but not limited to: a guide sequence optionally linked to a tracr mate sequence, a tracr sequence, one or more Cas effectors, and combinations thereof and (b) allowing a CRISPR-Cas complex to bind to one or more target polynucleotides, e.g., to effect cleavage, nicking, or other modification of the target polynucleotide within said disease gene, wherein the CRISPR-Cas complex is composed of one or more CRISPR-Cas effectors complexed with (1) one or more guide sequences that is/are hybridized to the target sequence(s) within the target polynucleotide(s), and optionally (2) the tracr mate sequence(s) that is/are hybridized to the tracr sequence(s), thereby generating a model eukaryotic cell comprising one or more mutated disease gene(s). Thus, in some embodiments the CRISPR-Cas system contains nucleic acid molecules for and drives expression of one or more of: a Cas effector, a guide sequence linked to a tracr mate sequence, and a tracr sequence and/or a Homologous Recombination template and/or a stabilizing ligand if the Cas effector has a destabilization domain. In some embodiments, said cleavage comprises cleaving one or two strands at the location of the target sequence by the Cas effector(s). In some embodiments, nicking comprises nicking one or two strands at the location of the target sequence by the Cas effector(s). In some embodiments, said cleavage or nicking results in modified transcription of a target polynucleotide. In some embodiments, modification results in decreased transcription of the target polynucleotide. In some embodiments, the method further comprises repairing said cleaved or nicked target polynucleotide by homologous recombination with an exogenous template polynucleotide, wherein said repair results in a mutation comprising an insertion, deletion, or substitution of one or more nucleotides of said target polynucleotide. In some embodiments, said mutation results in one or more amino acid changes in a protein expression from a gene comprising the target sequence.

The disease modeled can be any disease with a genetic or epigenetic component. In some embodiments, the disease modeled can be any as discussed elsewhere herein, including but not limited to any as set forth in Tables 11 and 12 herein or any as set forth in any one or more of a disease identified as being caused or attributed to a mtDNA mutation set forth at mitomap.org.

In Situ Disease Detection

The CRISPR-Cas systems and/or components thereof can be used for diagnostic methods of detection such as in CASFISH (see e.g. Deng et al. 2015. PNAS USA 112(38): 11870-11875), CRISPR-Live FISH (see e.g. Wang et al. 2020. Science; 365(6459):1301-1305), sm-FISH (Lee and Jefcoate. 2017. Front. Endocrinol. doi.org/10.3389/fendo.2017.00289), sequential FISH CRISPRainbow (Ma et al. Nat Biotechnol, 34 (2016), pp. 528-530), CRISPR-Sirius (Nat Methods, 15 (2018), pp. 928-931), Casilio (Cheng et al. Cell Res, 26 (2016), pp. 254-257), Halo-Tag based genomic loci visualization techniques (e.g. Deng et al. 2015. PNAS USA 112(38): 11870-11875; Knight et al., Science, 350 (2015), pp. 823-826), RNA-aptamer based methods (e.g. Ma et al., J Cell Biol, 214 (2016), pp. 529-537), molecular beacon-based methods (e.g. Zhao et al. Biomaterials, 100 (2016), pp. 172-183; Wu et al., 2018. 46(13): e80 ncbi.nlm-.nih.gov/pmc/articles/PMC6061827/)), Quantum Dot-based systems (e.g. Ma et al. Anal Chem, 89 (2017), pp. 12896-12901), multiplexed methods (e.g. Ma et al., Proc Natl Acad Sci USA, 112 (2015), pp. 3002-3007; Fu et al. Nat Commun, 7 (2016), p. 11707; Ma et al. Nat Biotechnol, 34 (2016), pp. 528-530; Shao et al. Nucleic Acids Res, 44 (2016), Article e86); Wang et al. Sci Rep, 6 (2016), p. 26857), 9, and other in situ CRISPR-hybridization based methods (e.g. Chen et al. Cell, 155 (2013), pp. 1479-1491; Gu et al. Science, 359 (2018), pp. 1050-1055; Tanebaum et al. Cell, 159 (2014), pp. 635-646; Ye et al. Protein Cell, 8 (2017), pp. 853-855; Chen et al. Nat Commun, 9 (2018), p. 5065; Shao, et al., ACS Synth Biol. 2018 Jan. 19; 7(1):176-18 pubmed.ncbi.nlrn-.nih.gov/28849913; Fu et al. Nat Commun, 7 (2016), p. 11707; Shao et al. Nucleic Acids Res, 44 (2016), Article e86; Wang et al., Sci Rep, 6 (2016), p. 26857), all of which are incorporated by reference herein as if expressed in their entirety and whose teachings can be adapted to the CRISPR-Cas systems and components thereof described herein in view of the description herein.

In some embodiments, the CRISPR-Cas system or component thereof can be used in a detection method, such as an in situ detection method described herein. In some embodiments, the CRISPR-Cas system or component thereof can include a catalytically inactivate Cas effector described herein, preferably an inactivated small Type II-D Cas (dsmall Type II-D Cas) and use this system in detection methods such as fluorescence in situ hybridization (FISH) or any other described herein. In some embodiments, the inactivated Cas effector, which lacks the ability to produce DNA double-strand breaks may be fused with a marker, such as fluorescent protein, such as the enhanced green fluorescent protein (eEGFP) and co-expressed with small guide RNAs to target pericentric, centric and telomeric repeats in vivo. The dCas effector or system thereof can be used to visualize both repetitive sequences and individual genes in the human genome. Such new applications of labelled dCas effector and CRISPR-Cas systems thereof can be important in imaging cells and studying the functional nuclear architecture, especially in cases with a small nucleus volume or complex 3-D structures.

Cell Selection

In some embodiments, the CRISPR-Cas systems and/or components thereof described herein can be used in a method to screen and/or select cells. In some embodiments, CRISPR-Cas system-based screening/selection method can be used to identify diseased cells in a cell population. In some embodiments, selection of the cells results in a modification in the cells such that the selected cells die. In this way, diseased cells can be identified, and removed from the healthy cell population. In some embodiments, the diseased cells can be a cancer cell, pre-cancerous cell, a virus or other pathogenic organism infected cells, or otherwise abnormal cell. In some embodiments, the modification can impart another detectable change in the cells to be selected (e.g. a functional change and/or genomic barcode) that facilitates selection of the desired cells. In some embodiments a negative selection scheme can be used to obtain a desired cell population. In these embodiments, the cells to be selected against are modified, thus can be removed from the cell population based on their death or identification or sorting based the detectable change imparted on the cells. Thus, in these embodiments, the remaining cells after selection are the desired cell population.

In some embodiments, a method of selecting one or more cell(s) containing a polynucleotide modification can include: introducing one or more CRISPR-Cas system(s) and/or components thereof, and/or CRISPR-Cas vectors or vector systems into the cell(s), wherein the CRISPR-Cas system(s) and/or components thereof, and/or CRISPR-Cas vectors or vector systems contains and/or is capable of expressing one or more of: a Cas effector, a guide sequence optionally linked to a tracr mate sequence, a tracr sequence, and an editing template; wherein, for example that which is being expressed is within and expressed in vivo by the CRISPR-Cas system vector or vector system and/or the editing template comprises the one or more mutations that abolish Cas effector cleavage; allowing homologous recombination of the editing template with the target polynucleotide in the cell(s) to be selected; allowing a CRISPR complex to bind to a target polynucleotide to effect cleavage of the target polynucleotide within said gene, wherein the AAV-CRISPR complex comprises the Cas effector complexed with (1) the guide sequence that is hybridized to the target sequence within the target polynucleotide, and (2) the tracr mate sequence that is hybridized to the tracr sequence, wherein binding of the CRISPR complex to the target polynucleotide induces cell death or imparts some other detectable change to the cell, thereby allowing one or more cell(s) in which one or more mutations have been introduced to be selected. In a preferred embodiment, the Cas effector is a Cas 9 or Cas12. In some embodiments, the cell to be selected may be a eukaryotic cell. In some embodiments, the cell to be selected may be a prokaryotic cell. Selection of specific cells via the methods herein can be performed without requiring a selection marker or a two-step process that may include a counter-selection system.

Therapeutic Agent Development

The CRISPR-Cas systems and components thereof described herein can be used to develop CRISPR-Cas-based and non-CRISPR-Cas-based biologically active agents, such as small molecule therapeutics. As used herein, "active agent" or "active ingredient" refers to a substance, compound, or molecule, which is biologically active or otherwise, induces a biological or physiological effect on a subject to which it is administered to. In other words, "active agent" or "active ingredient" refers to a component or components of a composition to which the whole or part of the effect of the composition is attributed. As used herein, "agent" refers to any substance, compound, molecule, and the like, which can be biologically active or otherwise can induce a biological and/or physiological effect on a subject to which it is administered to. An agent can be a primary active agent, or in other words, the component(s) of a composition to which the whole or part of the effect of the composition is attributed. An agent can be a secondary agent, or in other words, the component(s) of a composition to which an additional part and/or other effect of the composition is attributed. Thus, described herein are methods for developing a biologically active agent that modulates a cell function and/or signaling event associated with a disease and/or disease gene. In some embodiments, the method comprises (a) contacting a test compound with a diseased cell and/or a cell containing a disease gene cell; and (b) detecting a change in a readout that is indicative of a reduction or an augmentation of a cell signaling event or other cell functionality associated with said disease or disease gene, thereby developing said biologically active agent that modulates said cell signaling event or other functionality associated with said disease gene. In some embodiments, the diseased cell is a model cell described elsewhere herein. In some embodiments, the diseased cell is a diseased cell isolated from a subject in need of treatment. In some embodiments, the test compound is a small molecule agent. In some embodiments, test compound is a small molecule agent. In some embodiments, the test compound is a biologic molecule agent.

In some embodiments, the method involves developing a therapeutic based on the CRISPR-Cas system described herein. In particular embodiments, the therapeutic comprises a Cas effector and/or a guide RNA capable of hybridizing to a target sequence of interest. In particular embodiments, the therapeutic is a CRISPR-Cas vector or vector system that can contain a) a first regulatory element operably linked to a nucleotide sequence encoding the Cas effector protein(s); and b) a second regulatory element operably linked to one or more nucleotide sequences encoding one or more nucleic acid molecules comprising a guide RNA comprising a guide sequence, a direct repeat sequence; wherein components (a) and (b) are located on same or different vectors. In particular embodiments, the biologically active agent is a composition comprising a delivery system operably configured to deliver CRISPR-Cas system or components thereof, and/or or one or more polynucleotide sequences, vectors, or vector systems containing or encoding said components into a cell and capable of forming a CRISPR-Cas complex, and wherein said CRISPR-Cas complex is operable in the cell. In some embodiments, the CRISPR-Cas complex can include the Cas effector protein(s) as described herein, guide RNA comprising the guide sequence, and a direct repeat sequence. In any such compositions, the delivery system can be a yeast system, a lipofection system, a microinjection system, a biolistic system, virosomes, liposomes, immunoliposomes, polycations, lipid:nucleic acid conjugates or artificial virions, or any other system as described herein. In particular embodiments, the delivery is via a particle, a nanoparticle, a lipid or a cell penetrating peptide (CPP).

Also described herein are methods for developing or designing a CRISPR-Cas system, optionally a CRISPR-Cas system based therapy or therapeutic, comprising (a) selecting for a (therapeutic) locus of interest gRNA target sites, wherein said target sites have minimal sequence variation across a population, and from said selected target sites subselecting target sites, wherein a gRNA directed against said target sites recognizes a minimal number of off-target sites across said population, or (b) selecting for a (therapeutic) locus of interest gRNA target sites, wherein said target sites have minimal sequence variation across a population, or selecting for a (therapeutic) locus of interest gRNA target sites, wherein a gRNA directed against said target sites recognizes a minimal number of off-target sites across said population, and optionally estimating the number of (sub) selected target sites needed to treat or otherwise modulate or manipulate a population, and optionally validating one or more of the (sub)selected target sites for an individual subject, optionally designing one or more gRNA recognizing one or more of said (sub)selected target sites.

In some embodiments, the method for developing or designing a gRNA for use in a CRISPR-Cas system, optionally a CRISPR-Cas system based therapy or therapeutic, can include (a) selecting for a (therapeutic) locus of interest gRNA target sites, wherein said target sites have minimal sequence variation across a population, and from said selected target sites subselecting target sites, wherein a gRNA directed against said target sites recognizes a minimal number of off-target sites across said population, or (b) selecting for a (therapeutic) locus of interest gRNA target sites, wherein said target sites have minimal sequence variation across a population, or selecting for a (therapeutic) locus of interest gRNA target sites, wherein a gRNA directed against said target sites recognizes a minimal number of off-target sites across said population, and optionally estimating the number of (sub)selected target sites needed to treat or otherwise modulate or manipulate a population, optionally validating one or more of the (sub)selected target sites for an individual subject, optionally designing one or more gRNA recognizing one or more of said (sub)selected target sites.

In some embodiments, the method for developing or designing a CRISPR-Cas system, optionally a CRISPR-Cas system based therapy or therapeutic in a population, can include (a) selecting for a (therapeutic) locus of interest gRNA target sites, wherein said target sites have minimal sequence variation across a population, and from said selected target sites subselecting target sites, wherein a gRNA directed against said target sites recognizes a minimal number of off-target sites across said population, or (b) selecting for a (therapeutic) locus of interest gRNA target sites, wherein said target sites have minimal sequence variation across a population, or selecting for a (therapeutic) locus of interest gRNA target sites, wherein a gRNA directed against said target sites recognizes a minimal number of off-target sites across said population, and optionally estimating the number of (sub)selected target sites needed to treat or otherwise modulate or manipulate a population, optionally validating one or more of the (sub)selected target sites for an individual subject, optionally designing one or more gRNA recognizing one or more of said (sub)selected target sites.

In some embodiments the method for developing or designing a gRNA for use in a CRISPR-Cas system, optionally a CRISPR-Cas system based therapy or therapeutic in a population, can include (a) selecting for a (therapeutic) locus of interest gRNA target sites, wherein said target sites have minimal sequence variation across a population, and from said selected target sites subselecting target sites, wherein a gRNA directed against said target sites recognizes a minimal number of off-target sites across said population, or (b) selecting for a (therapeutic) locus of interest gRNA target sites, wherein said target sites have minimal sequence variation across a population, or selecting for a (therapeutic) locus of interest gRNA target sites, wherein a gRNA directed against said target sites recognizes a minimal number of off-target sites across said population, and optionally estimating the number of (sub)selected target sites needed to treat or otherwise modulate or manipulate a population, optionally validating one or more of the (sub)selected target sites for an individual subject, optionally designing one or more gRNA recognizing one or more of said (sub)selected target sites.

In some embodiments, the method for developing or designing a CRISPR-Cas system, such as a CRISPR-Cas system based therapy or therapeutic, optionally in a population; or for developing or designing a gRNA for use in a CRISPR-Cas system, optionally a CRISPR-Cas system based therapy or therapeutic, optionally in a population, can include: selecting a set of target sequences for one or more loci in a target population, wherein the target sequences do not contain variants occurring above a threshold allele frequency in the target population (i.e. platinum target sequences); removing from said selected (platinum) target sequences any target sequences having high frequency off-target candidates (relative to other (platinum) targets in the set) to define a final target sequence set; preparing one or more, such as a set of CRISPR-Cas systems based on the final target sequence set, optionally wherein a number of CRISP-Cas systems prepared is based (at least in part) on the size of a target population.

In certain embodiments, off-target candidates/off-targets, PAM restrictiveness, target cleavage efficiency, or effector protein specificity is identified or determined using a sequencing-based double-strand break (DSB) detection assay, such as described herein elsewhere. In certain embodiments, off-target candidates/off-targets are identified or determined using a sequencing-based double-strand break (DSB) detection assay, such as described herein elsewhere. In certain embodiments, off-targets, or off target candidates have at least 1, preferably 1-3, mismatches or (distal) PAM mismatches, such as 1 or more, such as 1, 2, 3, or more (distal) PAM mismatches. In certain embodiments, sequencing-based DSB detection assay comprises labeling a site of a DSB with an adapter comprising a primer binding site, labeling a site of a DSB with a barcode or unique molecular identifier, or combination thereof, as described herein elsewhere.

It will be understood that the guide sequence of the gRNA is 100% complementary to the target site, i.e. does not comprise any mismatch with the target site. It will be further understood that "recognition" of an (off-)target site by a gRNA presupposes CRISPR-Cas system functionality, i.e. an (off-)target site is only recognized by a gRNA if binding of the gRNA to the (off-)target site leads to CRISPR-Cas system activity (such as induction of single or double strand DNA cleavage, transcriptional modulation, etc.).

In certain embodiments, the target sites having minimal sequence variation across a population are characterized by absence of sequence variation in at least 99%, preferably at least 99.9%, more preferably at least 99.99% of the population. In certain embodiments, optimizing target location comprises selecting target sequences or loci having an absence of sequence variation in at least 99%, %, preferably at least 99.9%, more preferably at least 99.99% of a population. These targets are referred to herein elsewhere also as "platinum targets". In certain embodiments, said population comprises at least 1000 individuals, such as at least 5000 individuals, such as at least 10000 individuals, such as at least 50000 individuals.

In certain embodiments, the off-target sites are characterized by at least one mismatch between the off-target site and the gRNA. In certain embodiments, the off-target sites are characterized by at most five, preferably at most four, more preferably at most three mismatches between the off-target site and the gRNA. In certain embodiments, the off-target sites are characterized by at least one mismatch between the off-target site and the gRNA and by at most five, preferably at most four, more preferably at most three mismatches between the off-target site and the gRNA.

In certain embodiments, said minimal number of off-target sites across said population is determined for high-frequency haplotypes in said population. In certain embodiments, said minimal number of off-target sites across said population is determined for high-frequency haplotypes of the off-target site locus in said population. In certain embodiments, said minimal number of off-target sites across said population is determined for high-frequency haplotypes of the target site locus in said population. In certain embodiments, the high-frequency haplotypes are characterized by occurrence in at least 0.1% of the population.

In certain embodiments, the number of (sub)selected target sites needed to treat a population is estimated based on based low frequency sequence variation, such as low frequency sequence variation captured in large scale sequencing datasets. In certain embodiments, the number of (sub) selected target sites needed to treat a population of a given size is estimated.

In certain embodiments, the method further comprises obtaining genome sequencing data of a subject to be treated; and treating the subject with a CRISPR-Cas system selected from the set of CRISPR-Cas systems, wherein the CRISPR-Cas system selected is based (at least in part) on the genome sequencing data of the individual. In certain embodiments, the ((sub)selected) target is validated by genome sequencing, preferably whole genome sequencing.

In certain embodiments, target sequences or loci as described herein are (further) selected based on optimization of one or more parameters, such as PAM type (natural or modified), PAM nucleotide content, PAM length, target sequence length, PAM restrictiveness, target cleavage efficiency, and target sequence position within a gene, a locus or other genomic region. Methods of optimization are discussed in greater detail elsewhere herein.

In certain embodiments, target sequences or loci as described herein are (further) selected based on optimization of one or more of target loci location, target length, target specificity, and PAM characteristics. As used herein, PAM characteristics may comprise for instance PAM sequence, PAM length, and/or PAM GC contents. In certain embodiments, optimizing PAM characteristics comprises optimizing nucleotide content of a PAM. In certain embodiments, optimizing nucleotide content of PAM is selecting a PAM with a motif that maximizes abundance in the one or more target loci, minimizes mutation frequency, or both. Minimizing mutation frequency can for instance be achieved by selecting PAM sequences devoid of or having low or minimal CpG.

In certain embodiments, the effector protein for each CRISPR-Cas system in the set of CRISPR-Cas systems is selected based on optimization of one or more parameters selected from the group consisting of, effector protein size, ability of effector protein to access regions of high chromatin accessibility, degree of uniform enzyme activity across genomic targets, epigenetic tolerance, mismatch/budge tolerance, effector protein specificity, effector protein stability or half-life, effector protein immunogenicity or toxicity. Methods of optimization are discussed in greater detail elsewhere herein.

Gene Drives

In some embodiments, the small Type II-D Cas CRISPR-Cas systems described herein can be used to provide RNA-guided gene drives, for example in systems analogous to gene drives described in PCT Patent Publication WO 2015/105928. Systems of this kind may for example provide methods for altering eukaryotic germline cells, by introducing into the germline cell a nucleic acid sequence encoding an RNA-guided DNA nuclease and one or more guide RNAs. The guide RNAs may be designed to be complementary to one or more target locations on genomic DNA of the germline cell. The nucleic acid sequence encoding the RNA guided DNA nuclease and the nucleic acid sequence encoding the guide RNAs may be provided on constructs between flanking sequences, with promoters arranged such that the germline cell may express the RNA guided DNA nuclease and the guide RNAs, together with any desired cargo-encoding sequences that are also situated between the flanking sequences. The flanking sequences will typically include a sequence which is identical to a corresponding sequence on a selected target chromosome, so that the flanking sequences work with the components encoded by the construct to facilitate insertion of the foreign nucleic acid construct sequences into genomic DNA at a target cut site by mechanisms such as homologous recombination, to render the germline cell homozygous for the foreign nucleic acid sequence. In this way, gene-drive systems are capable of introgressing desired cargo genes throughout a breeding population (Gantz et al., 2015, Highly efficient Cas9-mediated gene drive for population modification of the malaria vector mosquito *Anopheles stephensi*, PNAS 2015, published ahead of print Nov. 23, 2015, doi:10.1073/pnas.1521077112; Esvelt et al., 2014, Concerning RNA-guided gene drives for the alteration of wild populations eLife 2014; 3:e03401). In select embodiments, target sequences may be selected which have few potential off-target sites in a genome. Targeting multiple sites within a target locus, using multiple guide RNAs, may increase the cutting frequency and hinder the evolution of drive resistant alleles. Truncated guide RNAs may reduce off-target cutting. Paired nickases may be used instead of a single nuclease, to further increase specificity. Gene drive constructs may include cargo sequences encoding transcriptional regulators, for example to activate homologous recombination genes and/or repress non-homologous end-joining. Target sites may be chosen within an essential gene, so that non-homologous end-joining events may cause lethality rather than creating a drive-resistant allele. The gene drive constructs can be engineered to function in a range of hosts at a range of temperatures (Cho et al. 2013, Rapid and Tunable Control of Protein Stability in *Caenorhabditis elegans* Using a Small Molecule, PLoS ONE 8(8): e72393. doi:10.1371/journal.pone.0072393). These approaches can be adapted for use with the small Type II-D Cas proteins and systems thereof described herein.

Xenotransplantation

In some embodiments, the small Type II-D CRISPR-Cas systems described herein can be used to provide RNA-guided DNA nucleases adapted to be used to provide modified tissues for transplantation. For example, RNA-guided DNA nucleases may be used to knockout, knockdown or disrupt selected genes in an animal, such as a transgenic pig (such as the human heme oxygenase-1 transgenic pig line), for example by disrupting expression of genes that encode epitopes recognized by the human immune system, i.e. xenoantigen genes. Candidate porcine genes for disruption may for example include a (1,3)-galactosyltransferase and cytidine monophosphate-N-acetylneuraminic acid hydroxylase genes (see PCT Patent Publication WO 2014/066505). In addition, genes encoding endogenous retroviruses may be disrupted, for example the genes encoding all porcine endogenous retroviruses (see Yang et al., 2015, Genome-wide inactivation of porcine endogenous retroviruses (PERVs), Science 27 Nov. 2015: Vol. 350 no. 6264 pp. 1101-1104). In addition, RNA-guided DNA nucleases may be used to target a site for integration of additional genes in xenotransplant donor animals, such as a human CD55 gene to improve protection against hyperacute rejection.

Optimization of CRISPR-Cas Systems

The methods of the present invention can involve optimization of selected parameters or variables associated with the CRISPR-Cas system and/or its functionality, as described herein further elsewhere. Optimization of the CRISPR-Cas system in the methods as described herein may depend on the target(s), such as the therapeutic target or therapeutic targets, the mode or type of CRISPR-Cas system modulation, such as CRISPR-Cas system based therapeutic target(s) modulation, modification, or manipulation, as well as the delivery of the CRISPR-Cas system components. One or more targets may be selected, depending on the genotypic and/or phenotypic outcome. For instance, one or more therapeutic targets may be selected, depending on (genetic) disease etiology or the desired therapeutic outcome. The (therapeutic) target(s) may be a single gene, locus, or other genomic site, or may be multiple genes, loci or other genomic sites. As is known in the art, a single gene, locus, or other genomic site may be targeted more than once, such as by use of multiple gRNAs.

CRISPR-Cas system activity, such as CRISPR-Cas system-based therapy or therapeutics may involve target disruption, such as target mutation, such as leading to gene knockout. CRISPR-Cas system activity, such as CRISPR-Cas system-based therapy or therapeutics may involve replacement of particular target sites, such as leading to target correction. CRISPR-Cas system-based therapy or therapeutics may involve removal of particular target sites, such as leading to target deletion. CRISPR-Cas system activity, such as CRISPR-Cas system-based therapy or therapeutics may involve modulation of target site functionality, such as target site activity or accessibility, leading for instance to (transcriptional and/or epigenetic) gene or genomic region activation or gene or genomic region silencing. The skilled person will understand that modulation of target site functionality may involve CRISPR effector mutation (such as for instance generation of a catalytically inactive CRISPR effector) and/or functionalization (such as for instance fusion of the CRISPR effector with a heterologous functional domain, such as a transcriptional activator or repressor), as described herein elsewhere.

Accordingly, in some embodiments, the invention relates to a method as described herein, comprising selection of one or more (therapeutic) target, selecting one or more CRISPR-Cas system functionality, and optimization of selected parameters or variables associated with the CRISPR-Cas system and/or its functionality. In a related embodiment, the invention relates to a method as described herein, comprising (a) selecting one or more (therapeutic) target loci, (b) selecting one or more CRISPR-Cas system functionalities, (c) optionally selecting one or more modes of delivery, and preparing, developing, or designing a CRISPR-Cas system selected based on steps (a)-(c).

In certain embodiments, CRISPR-Cas system functionality comprises genomic mutation. In certain embodiments, CRISPR-Cas system functionality comprises single genomic mutation. In certain embodiments, CRISPR-Cas system functionality comprises multiple genomic mutation. In certain embodiments, CRISPR-Cas system functionality comprises gene knockout. In certain embodiments, CRISPR-Cas system functionality comprises single gene knockout. In certain embodiments, CRISPR-Cas system functionality comprises multiple gene knockout. In certain embodiments, CRISPR-Cas system functionality comprises gene correction. In certain embodiments, CRISPR-Cas system functionality comprises single gene correction. In certain embodiments, CRISPR-Cas system functionality comprises multiple gene correction. In certain embodiments, CRISPR-Cas system functionality comprises genomic region correction. In certain embodiments, CRISPR-Cas system functionality comprises single genomic region correction. In certain embodiments, CRISPR-Cas system functionality comprises multiple genomic region correction. In certain embodiments, CRISPR-Cas system functionality comprises gene deletion. In certain embodiments, CRISPR-Cas system functionality comprises single gene deletion. In certain embodiments, CRISPR-Cas system functionality comprises multiple gene deletion. In certain embodiments, CRISPR-Cas system functionality comprises genomic region deletion. In certain embodiments, CRISPR-Cas system functionality comprises single genomic region deletion. In certain embodiments, CRISPR-Cas system functionality comprises multiple genomic region deletion. In certain embodiments, CRISPR-Cas system functionality comprises modulation of gene or genomic region functionality. In certain embodiments, CRISPR-Cas system functionality comprises modulation of single gene or genomic region functionality. In certain embodiments, CRISPR-Cas system functionality comprises modulation of multiple gene or genomic region functionality. In certain embodiments, CRISPR-Cas system functionality comprises gene or genomic region functionality, such as gene or genomic region activity. In certain embodiments, CRISPR-Cas system functionality comprises single gene or genomic region functionality, such as gene or genomic region activity. In certain embodiments, CRISPR-Cas system functionality comprises multiple gene or genomic region functionality, such as gene or genomic region activity. In certain embodiments, CRISPR-Cas system functionality comprises modulation gene activity or accessibility optionally leading to transcriptional and/or epigenetic gene or genomic region activation or gene or genomic region silencing. In certain embodiments, CRISPR-Cas system functionality comprises modulation single gene activity or accessibility optionally leading to transcriptional and/or epigenetic gene or genomic region activation or gene or genomic region silencing. In certain embodiments, CRISPR-Cas system functionality comprises modulation multiple gene activity or accessibility optionally leading to transcriptional and/or epigenetic gene or genomic region activation or gene or genomic region silencing.

Optimization of selected parameters or variables in the methods as described herein may result in optimized or improved CRISPR-Cas system, such as CISPR-Cas system-based therapy or therapeutic, specificity, efficacy, and/or safety. In certain embodiments, one or more of the following parameters or variables are taken into account, are selected, or are optimized in the methods of the invention as described herein: Cas protein allosteric interactions, Cas protein functional domains and functional domain interactions, CRISPR effector specificity, gRNA specificity, CRISPR-Cas complex specificity, PAM restrictiveness, PAM type (natural or modified), PAM nucleotide content, PAM length, CRISPR effector activity, gRNA activity, CRISPR-Cas complex activity, target cleavage efficiency, target site selection, target sequence length, ability of effector protein to access regions of high chromatin accessibility, degree of uniform enzyme activity across genomic targets, epigenetic tolerance, mismatch/budge tolerance, CRISPR effector stability, CRISPR effector mRNA stability, gRNA stability, CRISPR-Cas complex stability, CRISPR effector protein or mRNA immunogenicity or toxicity, gRNA immunogenicity or toxicity, CRISPR-Cas complex immunogenicity or toxicity, CRISPR effector protein or mRNA dose or titer, gRNA dose or titer, CRISPR-Cas complex dose or titer, CRISPR effector protein size, CRISPR effector expression level, gRNA expression level, CRISPR-Cas complex expression level, CRISPR effector spatiotemporal expression, gRNA spatiotemporal expression, CRISPR-Cas complex spatiotemporal expression.

By means of example, and without limitation, parameter or variable optimization may be achieved as follows. CRISPR effector specificity may be optimized by selecting the most specific CRISPR effector. This may be achieved for instance by selecting the most specific CRISPR effector orthologue or by specific CRISPR effector mutations which increase specificity. gRNA specificity may be optimized by selecting the most specific gRNA. This can be achieved for instance by selecting gRNA having low homology, i.e. at least one or preferably more, such as at least 2, or preferably at least 3, mismatches to off-target sites. CRISPR-Cas complex specificity may be optimized by increasing CRISPR effector specificity and/or gRNA specificity as above. PAM restrictiveness may be optimized by selecting a CRISPR effector having to most restrictive PAM recognition. This can be achieved for instance by selecting a CRISPR effector orthologue having more restrictive PAM recognition or by specific CRISPR effector mutations which increase or alter PAM restrictiveness. PAM type may be optimized for instance by selecting the appropriate CRISPR effector, such as the appropriate CRISPR effector recognizing a desired PAM type. The CRISPR effector or PAM type may be naturally occurring or may for instance be optimized based on CRISPR effector mutants having an altered PAM recognition, or PAM recognition repertoire. PAM nucleotide content may for instance be optimized by selecting the appropriate CRISPR effector, such as the appropriate CRISPR effector recognizing a desired PAM nucleotide content. The CRISPR effector or PAM type may be naturally occurring or may for instance be optimized based on CRISPR effector mutants having an altered PAM recognition, or PAM recognition repertoire. PAM length may for instance be optimized by selecting the appropriate CRISPR effector, such as the appropriate CRISPR effector recognizing a desired PAM nucleotide length. The CRISPR effector or PAM type may be naturally occurring or may for instance be optimized based on CRISPR effector mutants having an altered PAM recognition, or PAM recognition repertoire.

Target length or target sequence length may for instance be optimized by selecting the appropriate CRISPR effector, such as the appropriate CRISPR effector recognizing a desired target or target sequence nucleotide length. Alternatively, or in addition, the target (sequence) length may be optimized by providing a target having a length deviating from the target (sequence) length typically associated with the CRISPR effector, such as the naturally occurring CRISPR effector. The CRISPR effector or target (sequence) length may be naturally occurring or may for instance be optimized based on CRISPR effector mutants having an altered target (sequence) length recognition, or target (sequence) length recognition repertoire. For instance, increasing or decreasing target (sequence) length may influence target recognition and/or off-target recognition. CRISPR effector activity may be optimized by selecting the most active CRISPR effector. This may be achieved for instance by selecting the most active CRISPR effector orthologue or by specific CRISPR effector mutations which increase activity. The ability of the CRISPR effector protein to access regions of high chromatin accessibility, may be optimized by selecting the appropriate CRISPR effector or mutant thereof, and can consider the size of the CRISPR effector, charge, or other dimensional variables etc. The degree of uniform CRISPR effector activity may be optimized by selecting the appropriate CRISPR effector or mutant thereof, and can consider CRISPR effector specificity and/or activity, PAM specificity, target length, mismatch tolerance, epigenetic tolerance, CRISPR effector and/or gRNA stability and/or half-life, CRISPR effector and/or gRNA immunogenicity and/or toxicity, etc. gRNA activity may be optimized by selecting the most active gRNA. In some embodiments, this can be achieved by increasing gRNA stability through RNA modification. CRISPR-Cas complex activity may be optimized by increasing CRISPR effector activity and/or gRNA activity as above.

The target site selection may be optimized by selecting the optimal position of the target site within a gene, locus or other genomic region. The target site selection may be optimized by optimizing target location comprises selecting a target sequence with a gene, locus, or other genomic region having low variability. This may be achieved for instance by selecting a target site in an early and/or conserved exon or domain (i.e. having low variability, such as polymorphisms, within a population).

In certain embodiments, optimizing target (sequence) length comprises selecting a target sequence within one or more target loci between 5 and 25 nucleotides. In certain embodiments, a target sequence is 20 nucleotides.

In certain embodiments, optimizing target specificity comprises selecting targets loci that minimize off-target candidates.

In some embodiments, the target site may be selected by minimization of off-target effects (e.g. off-targets qualified as having 1-5, 1-4, or preferably 1-3 mismatches compared to target and/or having one or more PAM mismatches, such as distal PAM mismatches), preferably also considering variability within a population. CRISPR effector stability may be optimized by selecting CRISPR effector having appropriate half-life, such as preferably a short half-life while still capable of maintaining sufficient activity. In some embodiments, this can be achieved by selecting an appropriate CRISPR effector orthologue having a specific half-life or by specific CRISPR effector mutations or modifications which affect half-life or stability, such as inclusion (e.g. fusion) of stabilizing or destabilizing domains or sequences. CRISPR effector mRNA stability may be optimized by increasing or decreasing CRISPR effector mRNA stability. In some embodiments, this can be achieved by increasing or decreasing CRISPR effector mRNA stability through mRNA modification. gRNA stability may be optimized by increasing or decreasing gRNA stability. In some embodiments, this can be achieved by increasing or decreasing gRNA stability through RNA modification. CRISPR-Cas complex stability may be optimized by increasing or decreasing CRISPR effector stability and/or gRNA stability as above. CRISPR effector protein or mRNA immunogenicity or toxicity may be optimized by decreasing CRISPR effector protein or mRNA immunogenicity or toxicity. In some embodiments, this can be achieved by mRNA or protein modifications. Similarly, in case of DNA based expression systems, DNA immunogenicity or toxicity may be decreased. gRNA immunogenicity or toxicity may be optimized by decreasing gRNA immunogenicity or toxicity. In some embodiments, this can be achieved by gRNA modifications. Similarly, in case of DNA based expression systems, DNA immunogenicity or toxicity may be decreased. CRISPR-Cas complex immunogenicity or toxicity may be optimized by decreasing CRISPR effector immunogenicity or toxicity and/or gRNA immunogenicity or toxicity as above, or by selecting the least immunogenic or toxic CRISPR effector/gRNA combination. Similarly, in case of DNA based expression systems, DNA immunogenicity or toxicity may be decreased. CRISPR effector protein or mRNA dose or titer may be optimized by selecting dosage or titer to minimize toxicity and/or maximize specificity and/or efficacy. gRNA dose or titer may be optimized by selecting dosage or titer to minimize toxicity and/or maximize specificity and/or efficacy. CRISPR-Cas complex dose or titer may be optimized by selecting dosage or titer to minimize toxicity and/or maximize specificity and/or efficacy. CRISPR effector protein size may be optimized by selecting minimal protein size to increase efficiency of delivery, in particular for virus mediated delivery. CRISPR effector, gRNA, or CRISPR-Cas complex expression level may be optimized by limiting (or extending) the duration of expression and/or limiting (or increasing) expression level. This may be achieved for instance by using self-inactivating CRISPR-Cas systems, such as including a self-targeting (e.g. CRISPR effector targeting) gRNA, by using viral vectors having limited expression duration, by using appropriate promoters for low (or high) expression levels, by combining different delivery methods for individual CRISP-Cas system components, such as virus mediated delivery of CRISPR-effector encoding nucleic acid combined with non-virus mediated delivery of gRNA, or virus mediated delivery of gRNA combined with non-virus mediated delivery of CRISPR effector protein or mRNA. CRISPR effector, gRNA, or CRISPR-Cas complex spatiotemporal expression may be optimized by appropriate choice of conditional and/or inducible expression systems, including controllable CRISPR effector activity optionally a destabilized CRISPR effector and/or a split CRISPR effector, and/or cell- or tissue-specific expression systems.

In some embodiments, the invention relates to a method as described herein, comprising selection of one or more (therapeutic) target, selecting CRISPR-Cas system functionality, selecting CRISPR-Cas system mode of delivery, selecting CRISPR-Cas system delivery vehicle or expression system, and optimization of selected parameters or variables associated with the CRISPR-Cas system and/or its functionality, optionally wherein the parameters or variables are one or more selected from CRISPR effector specificity, gRNA specificity, CRISPR-Cas complex specificity, PAM restrictiveness, PAM type (natural or modified), PAM nucleotide content, PAM length, CRISPR effector activity, gRNA activity, CRISPR-Cas complex activity, target cleavage efficiency, target site selection, target sequence length, ability of effector protein to access regions of high chromatin accessibility, degree of uniform enzyme activity across genomic targets, epigenetic tolerance, mismatch/budge tolerance, CRISPR effector stability, CRISPR effector mRNA stability, gRNA stability, CRISPR-Cas complex stability, CRISPR effector protein or mRNA immunogenicity or toxicity, gRNA immunogenicity or toxicity, CRISPR-Cas complex immunogenicity or toxicity, CRISPR effector protein or mRNA dose or titer, gRNA dose or titer, CRISPR-Cas complex dose or titer, CRISPR effector protein size, CRISPR effector expression level, gRNA expression level, CRISPR-Cas complex expression level, CRISPR effector spatiotemporal expression, gRNA spatiotemporal expression, CRISPR-Cas complex spatiotemporal expression.

In some embodiments, the invention relates to a method as described herein, comprising selecting one or more (therapeutic) target, selecting one or more CRISPR-Cas system functionality, selecting one or more CRISPR-Cas system mode of delivery, selecting one or more CRISPR-Cas system delivery vehicle or expression system, and optimization of selected parameters or variables associated with the CRISPR-Cas system and/or its functionality, wherein specificity, efficacy, and/or safety are optimized, and optionally wherein optimization of specificity comprises optimizing one or more parameters or variables selected from CRISPR effector specificity, gRNA specificity, CRISPR-Cas complex specificity, PAM restrictiveness, PAM type (natural or modified), PAM nucleotide content, PAM length, wherein optimization of efficacy comprises optimizing one or more parameters or variables selected from CRISPR effector activity, gRNA activity, CRISPR-Cas complex activity, target cleavage efficiency, target site selection, target sequence length, CRISPR effector protein size, ability of effector protein to access regions of high chromatin accessibility, degree of uniform enzyme activity across genomic targets, epigenetic tolerance, mismatch/budge tolerance, and wherein optimization of safety comprises optimizing one or more parameters or variables selected from CRISPR effector stability, CRISPR effector mRNA stability, gRNA stability, CRISPR-Cas complex stability, CRISPR effector protein or mRNA immunogenicity or toxicity, gRNA immunogenicity or toxicity, CRISPR-Cas complex immunogenicity or toxicity, CRISPR effector protein or mRNA dose or titer, gRNA dose or titer, CRISPR-Cas complex dose or titer, CRISPR effector expression level, gRNA expression level, CRISPR-Cas complex expression level, CRISPR effector spatiotemporal expression, gRNA spatiotemporal expression, CRISPR-Cas complex spatiotemporal expression.

In some embodiments, the invention relates to a method as described herein, comprising optionally selecting one or more (therapeutic) target, optionally selecting one or more CRISPR-Cas system functionality, optionally selecting one or more CRISPR-Cas system mode of delivery, optionally selecting one or more CRISPR-Cas system delivery vehicle or expression system, and optimization of selected parameters or variables associated with the CRISPR-Cas system and/or its functionality, wherein specificity, efficacy, and/or safety are optimized, and optionally wherein optimization of specificity comprises optimizing one or more parameters or variables selected from CRISPR effector specificity, gRNA specificity, CRISPR-Cas complex specificity, PAM restrictiveness, PAM type (natural or modified), PAM nucleotide content, PAM length, wherein optimization of efficacy comprises optimizing one or more parameters or variables selected from CRISPR effector activity, gRNA activity, CRISPR-Cas complex activity, target cleavage efficiency, target site selection, target sequence length, CRISPR effector protein size, ability of effector protein to access regions of high chromatin accessibility, degree of uniform enzyme activity across genomic targets, epigenetic tolerance, mismatch/budge tolerance, and wherein optimization of safety comprises optimizing one or more parameters or variables selected from CRISPR effector stability, CRISPR effector mRNA stability, gRNA stability, CRISPR-Cas complex stability, CRISPR effector protein or mRNA immunogenicity or toxicity, gRNA immunogenicity or toxicity, CRISPR-Cas complex immunogenicity or toxicity, CRISPR effector protein or mRNA dose or titer, gRNA dose or titer, CRISPR-Cas complex dose or titer, CRISPR effector expression level, gRNA expression level, CRISPR-Cas complex expression level, CRISPR effector spatiotemporal expression, gRNA spatiotemporal expression, CRISPR-Cas complex spatiotemporal expression.

In some embodiments, the invention relates to a method as described herein, comprising optimization of selected parameters or variables associated with the CRISPR-Cas system and/or its functionality, wherein specificity, efficacy, and/or safety are optimized, and optionally wherein optimization of specificity comprises optimizing one or more parameters or variables selected from CRISPR effector specificity, gRNA specificity, CRISPR-Cas complex specificity, PAM restrictiveness, PAM type (natural or modified), PAM nucleotide content, PAM length, wherein optimization of efficacy comprises optimizing one or more parameters or variables selected from CRISPR effector activity, gRNA activity, CRISPR-Cas complex activity, target cleavage efficiency, target site selection, target sequence length, CRISPR effector protein size, ability of effector protein to access regions of high chromatin accessibility, degree of uniform enzyme activity across genomic targets, epigenetic tolerance, mismatch/budge tolerance, and wherein optimization of safety comprises optimizing one or more parameters or variables selected from CRISPR effector stability, CRISPR effector mRNA stability, gRNA stability, CRISPR-Cas complex stability, CRISPR effector protein or mRNA immunogenicity or toxicity, gRNA immunogenicity or toxicity, CRISPR-Cas complex immunogenicity or toxicity, CRISPR effector protein or mRNA dose or titer, gRNA dose or titer, CRISPR-Cas complex dose or titer, CRISPR effector expression level, gRNA expression level, CRISPR-Cas complex expression level, CRISPR effector spatiotemporal expression, gRNA spatiotemporal expression, CRISPR-Cas complex spatiotemporal expression.

It will be understood that the parameters or variables to be optimized as well as the nature of optimization may depend on the (therapeutic) target, the CRISPR-Cas system functionality, the CRISPR-Cas system mode of delivery, and/or the CRISPR-Cas system delivery vehicle or expression system.

In some embodiments, the invention relates to a method as described herein, comprising optimization of gRNA specificity at the population level. Preferably, said optimization of gRNA specificity comprises minimizing gRNA target site sequence variation across a population and/or minimizing gRNA off-target incidence across a population.

In some embodiments, optimization can result in selection of a CRISPR-Cas effector that is naturally occurring or is modified. In some embodiments, optimization can result in selection of a CRISPR-Cas effector that has nuclease, nickase, deaminase, transposase, and/or has one or more effector functionalities deactivated or eliminated. In some embodiments, optimizing a PAM specificity can include selecting a CRISPR-Cas effector with a modified PAM specificity. In some embodiments, optimizing can include selecting a CRISPR-Cas effector having a minimal size. In certain embodiments, optimizing effector protein stability comprises selecting an effector protein having a short half-life while maintaining sufficient activity, such as by selecting an appropriate CRISPR effector orthologue having a specific half-life or stability. In certain embodiments, optimizing immunogenicity or toxicity comprises minimizing effector protein immunogenicity or toxicity by protein modifications. In certain embodiments, optimizing functional specific comprises selecting a protein effector with reduced tolerance of mismatches and/or bulges between the guide RNA and one or more target loci.

In certain embodiments, optimizing efficacy comprises optimizing overall efficiency, epigenetic tolerance, or both. In certain embodiments, maximizing overall efficiency comprises selecting an effector protein with uniform enzyme activity across target loci with varying chromatin complexity, selecting an effector protein with enzyme activity limited to areas of open chromatin accessibility. In certain embodiments, chromatin accessibility is measured using one or more of ATAC-seq, or a DNA-proximity ligation assay. In certain embodiments, optimizing epigenetic tolerance comprises optimizing methylation tolerance, epigenetic mark competition, or both. In certain embodiments, optimizing methylation tolerance comprises selecting an effector protein that modify methylated DNA. In certain embodiments, optimizing epigenetic tolerance comprises selecting an effector protein unable to modify silenced regions of a chromosome, selecting an effector protein able to modify silenced regions of a chromosome, or selecting target loci not enriched for epigenetic markers.

In certain embodiments, selecting an optimized guide RNA comprises optimizing gRNA stability, gRNA immunogenicity, or both, or other gRNA associated parameters or variables as described herein elsewhere.

In certain embodiments, optimizing gRNA stability and/or gRNA immunogenicity comprises RNA modification, or other gRNA associated parameters or variables as described herein elsewhere. In certain embodiments, the modification comprises removing 1-3 nucleotides form the 3' end of a target complementarity region of the gRNA. In certain embodiments, modification comprises an extended gRNA and/or trans RNA/DNA element that create stable structures in the gRNA that compete with gRNA base pairing at a target of off-target loci, or extended complimentary nucleotides between the gRNA and target sequence, or both.

In certain embodiments, the mode of delivery comprises delivering gRNA and/or CRISPR effector protein, delivering gRNA and/or CRISPR effector mRNA, or delivering gRNA and/or CRISPR effector as a DNA based expression system. In certain embodiments, the mode of delivery further comprises selecting a delivery vehicle and/or expression systems from the group consisting of liposomes, lipid particles, nanoparticles, biolistics, or viral-based expression/delivery systems. In certain embodiments, expression is spatiotemporal expression is optimized by choice of conditional and/or inducible expression systems, including controllable CRISPR effector activity optionally a destabilized CRISPR effector and/or a split CRISPR effector, and/or cell- or tissue-specific expression system.

The methods as described herein may further involve selection of the CRISPR-Cas system mode of delivery. In certain embodiments, gRNA (and tracr, if and where needed, optionally provided as a sgRNA) and/or CRISPR effector protein are or are to be delivered. In certain embodiments, gRNA (and tracr, if and where needed, optionally provided as a sgRNA) and/or CRISPR effector mRNA are or are to be delivered. In certain embodiments, gRNA (and tracr, if and where needed, optionally provided as a sgRNA) and/or CRISPR effector provided in a DNA-based expression system are or are to be delivered. In certain embodiments, delivery of the individual CRISPR-Cas system components comprises a combination of the above modes of delivery. In certain embodiments, delivery comprises delivering gRNA and/or CRISPR effector protein, delivering gRNA and/or CRISPR effector mRNA, or delivering gRNA and/or CRISPR effector as a DNA based expression system.

The methods as described herein may further involve selection of the CRISPR-Cas system delivery vehicle and/or expression system. Delivery vehicles and expression systems are described herein elsewhere. By means of example, delivery vehicles of nucleic acids and/or proteins include nanoparticles, liposomes, etc. Delivery vehicles for DNA, such as DNA-based expression systems include for instance biolistics, viral based vector systems (e.g. adenoviral, AAV, lentiviral), etc. the skilled person will understand that selection of the mode of delivery, as well as delivery vehicle or expression system may depend on for instance the cell or tissues to be targeted. In certain embodiments, the delivery vehicle and/or expression system for delivering the CRISPR-Cas systems or components thereof comprises liposomes, lipid particles, nanoparticles, biolistics, or viral-based expression/delivery systems.

Considerations for Therapeutic Applications

A consideration in genome editing therapy is the choice of sequence-specific nuclease, such as a variant of a Cas (e.g., a small Type II-D Cas) nuclease. Each nuclease variant may possess its own unique set of strengths and weaknesses, many of which must be balanced in the context of treatment to maximize therapeutic benefit. For a specific editing therapy to be efficacious, a sufficiently high level of modification must be achieved in target cell populations to reverse disease symptoms. This therapeutic modification 'threshold' is determined by the fitness of edited cells following treatment and the amount of gene product necessary to reverse symptoms. With regard to fitness, editing creates three potential outcomes for treated cells relative to their unedited counterparts: increased, neutral, or decreased fitness. In the case of increased fitness, corrected cells may be able and expand relative to their diseased counterparts to mediate therapy. In this case, where edited cells possess a selective advantage, even low numbers of edited cells can be amplified through expansion, providing a therapeutic benefit to the patient. Where the edited cells possess no change in fitness, an increase the therapeutic modification threshold can be warranted. As such, significantly greater levels of editing may be needed to treat diseases, where editing creates a neutral fitness advantage, relative to diseases where editing creates increased fitness for target cells. If editing imposes a fitness disadvantage, as would be the case for restoring function to a tumor suppressor gene in cancer cells, modified cells would be outcompeted by their diseased counterparts, causing the benefit of treatment to be low relative to editing rates. This may be overcome with supplemental therapies to increase the potency and/or fitness of the edited cells relative to the diseased counterparts.

In addition to cell fitness, the amount of gene product necessary to treat disease can also influence the minimal level of therapeutic genome editing that can treat or prevent a disease or a symptom thereof. In cases where a small change in the gene product levels can result in significant changes in clinical outcome, the minimal level of therapeutic genome editing is less relative to cases where a larger change in the gene product levels are needed to gain a clinically relevant response. In some embodiments, the minimal level of therapeutic genome editing can range from 0.1 to 1%, 1-5%, 5-10%, 10-15%, 15-20%, 20-25%, 25-30%, 30-35%, 35-40%, 40-45%. 45-50%, or 50-55%. Thus, where a small change in gene product levels can influence clinical outcomes and diseases where there is a fitness advantage for edited cells, are ideal targets for genome editing therapy, as the therapeutic modification threshold is low enough to permit a high chance of success.

The activity of NHEJ and HDR DSB repair can vary by cell type and cell state. NHEJ is not highly regulated by the cell cycle and is efficient across cell types, allowing for high levels of gene disruption in accessible target cell populations. In contrast, HDR acts primarily during S/G2 phase, and is therefore restricted to cells that are actively dividing, limiting treatments that require precise genome modifications to mitotic cells [Ciccia, A. & Elledge, S. J. Molecular cell 40, 179-204 (2010); Chapman, J. R., et al. Molecular cell 47, 497-510 (2012)].

The efficiency of correction via HDR may be controlled by the epigenetic state or sequence of the targeted locus, or the specific repair template configuration (single vs. double stranded, long vs. short homology arms) used [Hacein-Bey-Abina, S., et al. The New England journal of medicine 346, 1185-1193 (2002); Gaspar, H. B., et al. Lancet 364, 2181-2187 (2004); Beumer et al., G3. 2013. 3(4):657-664, piubmed.nebi.nlm.nih.gov/23550125/]. The relative activity of NHEJ and HDR machineries in target cells may also affect gene correction efficiency, as these pathways may compete to resolve DSBs [Beumer, K. J., et al. Proceedings of the National Academy of Sciences of the United States of America 105, 19821-19826 (2008)]. HDR also imposes a delivery challenge not seen with NHEJ strategies, as it uses the concurrent delivery of nucleases and repair templates. Thus, these differences can be kept in mind when designing, optimizing, and/or selecting a CRISPR-Cas based therapeutic as described in greater detail elsewhere herein.

CRISPR-Cas-based polynucleotide modification application can include combinations of proteins, small RNA molecules, and/or repair templates, and can make, in some embodiments, delivery of these multiple parts substantially more challenging than, for example, traditional small molecule therapeutics. Two main strategies for delivery of CRISPR-Cas systems and components thereof have been developed: ex vivo and in vivo. In some embodiments of ex vivo treatments, diseased cells are removed from a subject, edited and then transplanted back into the patient. In other embodiments, cells from a healthy allogeneic donor are collected, modified using a CRISPR-Cas system or component thereof, to impart various functionalities and/or reduce immunogenicity, and administered to an allogeneic recipient in need of treatment. ex vivo editing has the advantage of allowing the target cell population to be well defined and the specific dosage of therapeutic molecules delivered to cells to be specified. The latter consideration may be particularly important when off-target modifications are a concern, as titrating the amount of nuclease may decrease such mutations (Hsu et al., 2013). Another advantage of ex vivo approaches is the typically high editing rates that can be achieved, due to the development of efficient delivery systems for proteins and nucleic acids into cells in culture for research and gene therapy applications.

In vivo polynucleotide modification via CRISPR-Cas systems and/or components thereof involves direct delivery of the CRISPR-Cas systems and/or components thereof to cell types in their native tissues. In vivo polynucleotide modification via CRISPR-Cas systems and/or components thereof allows diseases in which the affected cell population is not amenable to ex vivo manipulation to be treated. Furthermore, delivering CRISPR-Cas systems and/or components thereof to cells in situ allows for the treatment of multiple tissue and cell types.

In some embodiments, such as those where viral vector systems are used to generate viral particles to deliver the CRISPR-Cas system and/or component thereof to a cell, the total cargo size of the CRISPR-Cas system and/or component thereof should be considered as vector systems can have limits on the size of a polynucleotide that can be expressed therefrom and/or packaged into cargo inside of a viral particle. In some embodiments, the tropism of a vector system, such as a viral vector system, should be considered as it can impact the cell type to which the CRISPR-Cas system or component thereof can be efficiently and/or effectively delivered.

When delivering a CRISPR-Cas system or component thereof via a viral-based system, it can be important to consider the amount of viral particles that will be needed to achieve a therapeutic effect so as to account for the potential immune response that can be elicited by the viral particles when delivered to a subject or cell(s). When delivering a CRISPR-Cas system or component thereof via a viral based system, it can be important to consider mechanisms of controlling the distribution and/or dosage of the CRISRP-Cas system in vivo. Generally, to reduce the potential for off-target effects, it is optimal but not necessarily required, that the amount of the CRISPR-Cas system be as close to the minimum or least effective dose. In practice this can be challenging to do.

In some embodiments, it can be important to consider the immunogenicity of the CRISPR-Cas system or component thereof. In embodiments, where the immunogenicity of the CRISPR-Cas system or component thereof is of concern, the immunogenicity CRISPR-Cas system or component thereof can be reduced. By way of example only, the immunogenicity of the CRISPR-Cas system or component thereof can be reduced using the approach set out in Tangri et al. Accordingly, directed evolution or rational design may be used to reduce the immunogenicity of the CRISPR enzyme (for instance a Cas (e.g. Cas9 and/or Cas12)) in the host species (human or other species).

Methods of Using the CRISPR-Cas Systems in Plants and Fungi

The compositions, systems, and methods described herein can be used to perform gene or genome interrogation or editing or manipulation in plants and fungi. For example, the applications include investigation and/or selection and/or interrogations and/or comparison and/or manipulations and/or transformation of plant genes or genomes; e.g., to create, identify, develop, optimize, or confer trait(s) or characteristic(s) to plant(s) or to transform a plant or fungus genome. There can accordingly be improved production of plants, new plants with new combinations of traits or characteristics or new plants with enhanced traits. The compositions, systems, and methods can be used with regard to plants in Site-Directed Integration (SDI) or Gene Editing (GE) or any Near Reverse Breeding (NRB) or Reverse Breeding (RB) techniques.

The compositions, systems, and methods herein may be used to confer desired traits (e.g., enhanced nutritional quality, increased resistance to diseases and resistance to biotic and abiotic stress, and increased production of commercially valuable plant products or heterologous compounds) on essentially any plants and fungi, and their cells and tissues. The compositions, systems, and methods may be used to modify endogenous genes or to modify their expression without the permanent introduction into the genome of any foreign gene.

In some embodiments, compositions, systems, and methods may be used in genome editing in plants or where RNAi or similar genome editing techniques have been used previously; see, e.g., Nekrasov, "Plant genome editing made easy: targeted mutagenesis in model and crop plants using the CRISPR-Cas system," Plant Methods 2013, 9:39 (doi: 10.1186/1746-4811-9-39); Brooks, "Efficient gene editing in tomato in the first generation using the CRISPR-Cas9 system," Plant Physiology September 2014 pp 114.247577; Shan, "Targeted genome modification of crop plants using a CRISPR-Cas system," Nature Biotechnology 31, 686-688 (2013); Feng, "Efficient genome editing in plants using a CRISPR/Cas system," Cell Research (2013) 23:1229-1232. doi:10.1038/cr.2013.114; published online 20 Aug. 2013; Xie, "RNA-guided genome editing in plants using a CRISPR-Cas system," Mol Plant. 2013 November; 6(6): 1975-83. doi: 10.1093/mp/sst119. Epub 2013 Aug. 17; Xu, "Gene targeting using the *Agrobacterium tumefaciens*-mediated CRISPR-Cas system in rice," Rice 2014, 7:5 (2014), Zhou et al., "Exploiting SNPs for biallelic CRISPR mutations in the outcrossing woody perennial *Populus* reveals 4-coumarate: CoA ligase specificity and Redundancy," New Phytologist (2015) (Forum) 1-4 (available online only at www.newphytologist.com); Caliando et al, "Targeted DNA degradation using a CRISPR device stably carried in the host genome, NATURE COMMUNICATIONS 6:6989, DOI: 10.1038/ncomms7989, www.nature.com/naturecommunications DOI: 10.1038/ncomms7989; U.S. Pat. No. 6,603,061—*Agrobacterium*-Mediated Plant Transformation Method; U.S. Pat. No. 7,868,149—Plant Genome Sequences and Uses Thereof and US 2009/0100536—Transgenic Plants with Enhanced Agronomic Traits, Morrell et al "Crop genomics: advances and applications," Nat Rev Genet. 2011 Dec. 29; 13(2):85-96, all the contents and disclosure of each of which are herein incorporated by reference in their entirety. Embodiments and features of utilizing the compositions, systems, and methods may be analogous to the use of the CRISPR-Cas (e.g. CRISPR-Cas9) system in plants, and mention is made of the University of Arizona website "CRISPR-PLANT" (www.genome.arizona.edu/crispr/) (supported by Penn State and AGI).

The compositions, systems, and methods may also be used on protoplasts. A "protoplast" refers to a plant cell that has had its protective cell wall completely or partially removed using, for example, mechanical or enzymatic means resulting in an intact biochemical competent unit of living plant that can reform their cell wall, proliferate and regenerate grow into a whole plant under proper growing conditions.

The compositions, systems, and methods may be used for screening genes (e.g., endogenous, mutations) of interest. In some examples, genes of interest include those encoding enzymes involved in the production of a component of added nutritional value or generally genes affecting agronomic traits of interest, across species, phyla, and plant kingdom. By selectively targeting e.g., genes encoding enzymes of metabolic pathways, the genes responsible for certain nutritional aspects of a plant can be identified. Similarly, by selectively targeting genes which may affect a desirable agronomic trait, the relevant genes can be identified. Accordingly, the present invention encompasses screening methods for genes encoding enzymes involved in the production of compounds with a particular nutritional value and/or agronomic traits.

It is also understood that reference herein to animal cells may also apply, mutatis mutandis, to plant or fungal cells unless otherwise apparent; and the enzymes herein having reduced off-target effects and systems employing such enzymes can be used in plant applications, including those mentioned herein.

In some cases, nucleic acids introduced to plants and fungi may be codon optimized for expression in the plants and fungi. Methods of codon optimization include those described in Kwon K C, et al., Codon Optimization to Enhance Expression Yields Insights into Chloroplast Translation, Plant Physiol. 2016 September; 172(1):62-77.

The components (e.g., Cas proteins) in the compositions and systems may further comprise one or more functional domains described herein. In some examples, the functional domains may be an exonuclease. Such exonuclease may increase the efficiency of the Cas proteins' function, e.g., mutagenesis efficiency. An example of the functional domain is Trex2, as described in Weiss T et al., www.biorxiv.org/content/10.1101/2020.04.11.037572v1, doi: https://doi.org/10.1101/2020.04.11.037572.

Examples of Plants

The compositions, systems, and methods herein can be used to confer desired traits on essentially any plant. A wide variety of plants and plant cell systems may be engineered for the desired physiological and agronomic characteristics. In general, the term "plant" relates to any various photosynthetic, eukaryotic, unicellular or multicellular organism of the kingdom Plantae characteristically growing by cell division, containing chloroplasts, and having cell walls comprised of cellulose. The term plant encompasses monocotyledonous and dicotyledonous plants.

The compositions, systems, and methods may be used over a broad range of plants, such as for example with dicotyledonous plants belonging to the orders Magnoliales, Illiciales, Laurales, Piperales, Aristolochiales, Nymphaeales, Ranunculales, Papaverales, Sarraceniaceae, Trochodendrales, Hamamelidales, Eucommiales, Leitneriales, Myricales, Fagales, Casuarinales, Caryophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, Haloragales, Myrtales, Cornales, Proteales, San tales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanulales, Rubiales, Dipsacales, and Asterales; monocotyledonous plants such as those belonging to the orders Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Li/iales, and Orchidales, or with plants belonging to Gymnospermae, e.g. those belonging to the orders Pinales, Ginkgoales, Cycadales, Araucariales, Cupressales and Gnetales.

The compositions, systems, and methods herein can be used over a broad range of plant species, included in the non-limitative list of dicot, monocot or gymnosperm genera hereunder: *Atropa, Alseodaphne, Anacardium, Arachis, Beilschmiedia, Brassica, Carthamus, Cocculus, Croton, Cucumis, Citrus, Citrullus, Capsicum, Catharanthus, Cocos, Coffea, Cucurbita, Daucus, Duguetia, Eschscholzia, Ficus, Fragaria, Glaucium, Glycine, Gossypium, Helianthus, Hevea, Hyoscyamus, Lactuca, Landolphia, Linum, Litsea, Lycopersicon, Lupinus, Manihot, Majorana, Malus, Medicago, Nicotiana, Olea, Parthenium, Papaver, Persea, Phaseolus, Pistacia, Pisum, Pyrus, Prunus, Raphanus, Ricinus, Senecio, Sinomenium, Stephania, Sinapis, Solanum, Theobroma, Trifolium, Trigonella, Vicia, Vinca, Vilis*, and *Vigna*; and the genera *Allium, Andropogon, Eragrostis, Asparagus, Avena, Cynodon, Elaeis, Festuca, Festulolium, Heterocallis, Hordeum, Lemna, Lolium, Mus*a, *Oryza, Panicum, Pennisetum, Phleum, Poa, Secale, Sorghum, Triticum, Zea, Abies, Cunninghamia, Ephedra, Picea, Pinus*, and *Pseudotsuga*.

In some embodiments, target plants and plant cells for engineering include those monocotyledonous and dicotyledonous plants, such as crops including grain crops (e.g., wheat, maize, rice, millet, barley), fruit crops (e.g., tomato, apple, pear, strawberry, orange), forage crops (e.g., alfalfa), root vegetable crops (e.g., carrot, potato, sugar beets, yam), leafy vegetable crops (e.g., lettuce, spinach); flowering plants (e.g., petunia, rose, chrysanthemum), conifers and pine trees (e.g., pine fir, spruce); plants used in phytoremediation (e.g., heavy metal accumulating plants); oil crops (e.g., sunflower, rape seed) and plants used for experimental purposes (e.g., *Arabidopsis*). Specifically, the plants are intended to comprise without limitation angiosperm and gymnosperm plants such as acacia, alfalfa, amaranth, apple, apricot, artichoke, ash tree, asparagus, avocado, banana, barley, beans, beet, birch, beech, blackberry, blueberry, broccoli, Brussel's sprouts, cabbage, canola, cantaloupe, carrot, cassava, cauliflower, cedar, a cereal, celery, chestnut, cherry, Chinese cabbage, citrus, clementine, clover, coffee, corn, cotton, cowpea, cucumber, cypress, eggplant, elm, endive, eucalyptus, fennel, figs, fir, geranium, grape, grapefruit, groundnuts, ground cherry, gum hemlock, hickory, kale, kiwifruit, kohlrabi, larch, lettuce, leek, lemon, lime, locust, pine, maidenhair, maize, mango, maple, melon, millet, mushroom, mustard, nuts, oak, oats, oil palm, okra, onion, orange, an ornamental plant or flower or tree, papaya, palm, parsley, parsnip, pea, peach, peanut, pear, peat, pepper, persimmon, pigeon pea, pine, pineapple, plantain, plum, pomegranate, potato, pumpkin, radicchio, radish, rapeseed, raspberry, rice, rye, sorghum, safflower, sallow, soybean, spinach, spruce, squash, strawberry, sugar beet, sugarcane, sunflower, sweet potato, sweet corn, tangerine, tea, tobacco, tomato, trees, triticale, turf grasses, turnips, vine, walnut, watercress, watermelon, wheat, yams, yew, and zucchini.

The term plant also encompasses Algae, which are mainly photoautotrophs unified primarily by their lack of roots, leaves and other organs that characterize higher plants. The compositions, systems, and methods can be used over a broad range of "algae" or "algae cells." Examples of algae include eukaryotic phyla, including the Rhodophyta (red algae), Chlorophyta (green algae), Phaeophyta (brown algae), Bacillariophyta (diatoms), Eustigmatophyta and dinoflagellates as well as the prokaryotic phylum Cyanobacteria (blue-green algae). Examples of algae species include those of *Amphora, Anabaena, Ankistrodesmus, Botryococcus, Chaetoceros, Chlamydomonas, Chlorella, Chlorococcum, Cyclotella, Cylindrotheca, Dunaliella, Emiliania, Euglena, Haematococcus, Isochrysis, Monochrysis, Monoraphidium, Nannochloris, Nannochloropsis, Navicula, Nephrochloris, Nephroselmis, Nitzschia, Nodularia, Nostoc, Ochromonas, Oocystis, Oscillatoria, Pavlova, Phaeodactylum, Platymonas, Pleurochrysis, Porphyra, Pseudoanabaena, Pyramimonas, Stichococcus, Synechococcus, Synechocystis, Tetraselmis, Thalassiosira*, and *Trichodesmium*.

Plant Promoters

In order to ensure appropriate expression in a plant cell, the components of the components and systems herein may be placed under control of a plant promoter. A plant promoter is a promoter operable in plant cells. A plant promoter is capable of initiating transcription in plant cells, whether or not its origin is a plant cell. The use of different types of promoters is envisaged.

In some examples, the plant promoter is a constitutive plant promoter, which is a promoter that is able to express the open reading frame (ORF) that it controls in all or nearly all of the plant tissues during all or nearly all developmental stages of the plant (referred to as "constitutive expression"). One example of a constitutive promoter is the cauliflower mosaic virus 35S promoter. In some examples, the plant promoter is a regulated promoter, which directs gene expression not constitutively, but in a temporally- and/or spatially-regulated manner, and includes tissue-specific, tissue-preferred and inducible promoters. Different promoters may direct the expression of a gene in different tissues or cell types, or at different stages of development, or in response to different environmental conditions. In some examples, the plant promoter is a tissue-preferred promoters, which can be utilized to target enhanced expression in certain cell types within a particular plant tissue, for instance vascular cells in leaves or roots or in specific cells of the seed.

Exemplary plant promoters include those obtained from plants, plant viruses, and bacteria such as *Agrobacterium* or *Rhizobium* which comprise genes expressed in plant cells. Additional examples of promoters include those described in Kawamata et al., (1997) Plant Cell Physiol 38:792-803; Yamamoto et al., (1997) Plant J 12:255-65; Hire et al, (1992) Plant Mol Biol 20:207-18, Kuster et al, (1995) Plant Mol Biol 29:759-72, and Capana et al., (1994) Plant Mol Biol 25:681-91.

In some examples, a plant promoter may be an inducible promoter, which is inducible and allows for spatiotemporal control of gene editing or gene expression may use a form of energy. The form of energy may include sound energy, electromagnetic radiation, chemical energy and/or thermal energy. Examples of inducible systems include tetracycline inducible promoters (Tet-On or Tet-Off), small molecule two-hybrid transcription activations systems (FKBP, ABA, etc.), or light inducible systems (Phytochrome, LOV domains, or cryptochrome), such as a Light Inducible Transcriptional Effector (LITE) that direct changes in transcriptional activity in a sequence-specific manner. In a particular example, of the components of a light inducible system include a Cas protein, a light-responsive cytochrome heterodimer (e.g. from *Arabidopsis thaliana*), and a transcriptional activation/repression domain.

In some examples, the promoter may be a chemical-regulated promotor (where the application of an exogenous chemical induces gene expression) or a chemical-repressible promoter (where application of the chemical represses gene expression). Examples of chemical-inducible promoters include maize ln2-2 promoter (activated by benzene sulfonamide herbicide safeners), the maize GST promoter (activated by hydrophobic electrophilic compounds used as pre-emergent herbicides), the tobacco PR-1 a promoter (activated by salicylic acid), promoters regulated by antibiotics (such as tetracycline-inducible and tetracycline-repressible promoters).

Stable Integration in the Genome of Plants

In some embodiments, polynucleotides encoding the components of the compositions and systems may be introduced for stable integration into the genome of a plant cell. In some cases, vectors or expression systems may be used for such integration. The design of the vector or the expression system can be adjusted depending on for when, where and under what conditions the guide RNA and/or the Cas gene are expressed. In some cases, the polynucleotides may be integrated into an organelle of a plant, such as a plastid, mitochondrion or a chloroplast. The elements of the expression system may be on one or more expression constructs which are either circular such as a plasmid or transformation vector, or non-circular such as linear double stranded DNA.

In some embodiments, the method of integration generally comprises the steps of selecting a suitable host cell or host tissue, introducing the construct(s) into the host cell or host tissue, and regenerating plant cells or plants therefrom: In some examples, the expression system for stable integration into the genome of a plant cell may contain one or more of the following elements: a promoter element that can be used to express the RNA and/or Cas enzyme in a plant cell; a 5' untranslated region to enhance expression; an intron element to further enhance expression in certain cells, such as monocot cells; a multiple-cloning site to provide convenient restriction sites for inserting the guide RNA and/or the Cas gene sequences and other desired elements; and a 3' untranslated region to provide for efficient termination of the expressed transcript.

Transient Expression in Plants

In some embodiments, the components of the compositions and systems may be transiently expressed in the plant cell. In some examples, the compositions and systems may modify a target nucleic acid only when both the guide RNA and the Cas protein are present in a cell, such that genomic modification can further be controlled. As the expression of the Cas protein is transient, plants regenerated from such plant cells typically contain no foreign DNA. In certain examples, the Cas protein is stably expressed and the guide sequence is transiently expressed.

DNA and/or RNA (e.g., mRNA) may be introduced to plant cells for transient expression. In such cases, the introduced nucleic acid may be provided in sufficient quantity to modify the cell but do not persist after a contemplated period of time has passed or after one or more cell divisions.

The transient expression may be achieved using suitable vectors. Exemplary vectors that may be used for transient expression include a pEAQ vector (may be tailored for Agrobacterium-mediated transient expression) and Cabbage Leaf Curl virus (CaLCuV), and vectors described in Sainsbury F. et al., Plant Biotechnol J. 2009 September; 7(7): 682-93; and Yin K et al., Scientific Reports volume 5, Article number: 14926 (2015).

Combinations of the different methods described above are also envisaged.

Translocation to and/or Expression in Specific Plant Organelles

The compositions and systems herein may comprise elements for translocation to and/or expression in a specific plant organelle.

Chloroplast Targeting

In some embodiments, it is envisaged that the compositions and systems are used to specifically modify chloroplast genes or to ensure expression in the chloroplast. The compositions and systems (e.g., Cas proteins, guide molecules, or their encoding polynucleotides) may be transformed, compartmentalized, and/or targeted to the chloroplast. In an example, the introduction of genetic modifications in the plastid genome can reduce biosafety issues such as gene flow through pollen.

Examples of methods of chloroplast transformation include Particle bombardment, PEG treatment, and microinjection, and the translocation of transformation cassettes from the nuclear genome to the plastid. In some examples, targeting of chloroplasts may be achieved by incorporating in chloroplast localization sequence, and/or the expression construct a sequence encoding a chloroplast transit peptide (CTP) or plastid transit peptide, operably linked to the 5' region of the sequence encoding the components of the compositions and systems. Additional examples of transforming, targeting and localization of chloroplasts include those described in WO2010061186, Protein Transport into Chloroplasts, 2010, Annual Review of Plant Biology, Vol. 61: 157-180, and US 20040142476, which are incorporated by reference herein in their entireties.

Exemplary Applications in Plants

The compositions, systems, and methods may be used to generate genetic variation(s) in a plant (e.g., crop) of interest. One or more, e.g., a library of, guide molecules targeting one or more locations in a genome may be provided and introduced into plant cells together with the Cas effector protein. For example, a collection of genome-scale point mutations and gene knock-outs can be generated. In some examples, the compositions, systems, and methods may be used to generate a plant part or plant from the cells so obtained and screening the cells for a trait of interest. The target genes may include both coding and non-coding regions. In some cases, the trait is stress tolerance and the method is a method for the generation of stress-tolerant crop varieties.

In some embodiments, the compositions, systems, and methods are used to modify endogenous genes or to modify their expression. The expression of the components may induce targeted modification of the genome, either by direct activity of the Cas nuclease and optionally introduction of template DNA, or by modification of genes targeted. The different strategies described herein above allow Cas-mediated targeted genome editing without requiring the introduction of the components into the plant genome.

In some cases, the modification may be performed without the permanent introduction into the genome of the plant of any foreign gene, including those encoding CRISPR components, so as to avoid the presence of foreign DNA in the genome of the plant. This can be of interest as the regulatory requirements for non-transgenic plants are less rigorous. Components which are transiently introduced into the plant cell are typically removed upon crossing.

For example, the modification may be performed by transient expression of the components of the compositions and systems. The transient expression may be performed by delivering the components of the compositions and systems with viral vectors, delivery into protoplasts, with the aid of particulate molecules such as nanoparticles or CPPs.

Generation of Plants with Desired Traits

The compositions, systems, and methods herein may be used to introduce desired traits to plants. The approaches include introduction of one or more foreign genes to confer a trait of interest, editing or modulating endogenous genes to confer a trait of interest.

Agronomic Traits

In some embodiments, crop plants can be improved by influencing specific plant traits. Examples of the traits include improved agronomic traits such as herbicide resistance, disease resistance, abiotic stress tolerance, high yield, and superior quality, pesticide-resistance, disease resistance, insect and nematode resistance, resistance against parasitic weeds, drought tolerance, nutritional value, stress tolerance, self-pollination voidance, forage digestibility biomass, and grain yield.

In some embodiments, genes that confer resistance to pests or diseases may be introduced to plants. In cases there are endogenous genes that confer such resistance in plants, their expression and function may be enhanced (e.g., by introducing extra copies, modifications that enhance expression and/or activity).

Examples of genes that confer resistance include plant disease resistance genes (e.g., Cf-9, Pto, RSP2, SlDMR6-1), genes conferring resistance to a pest (e.g., those described in WO96/30517), *Bacillus thuringiensis* proteins, lectins, Vitamin-binding proteins (e.g., avidin), enzyme inhibitors (e.g., protease or proteinase inhibitors or amylase inhibitors), insect-specific hormones or pheromones (e.g., ecdysteroid or a juvenile hormone, variant thereof, a mimetic based thereon, or an antagonist or agonist thereof) or genes involved in the production and regulation of such hormone and pheromones, insect-specific peptides or neuropeptide, Insect-specific venom (e.g., produced by a snake, a wasp, etc., or analog thereof), Enzymes responsible for a hyper-accumulation of a monoterpene, a sesquiterpene, a steroid, hydroxamic acid, a phenylpropanoid derivative or another nonprotein molecule with insecticidal activity, Enzymes involved in the modification of biologically active molecule (e.g., a glycolytic enzyme, a proteolytic enzyme, a lipolytic enzyme, a nuclease, a cyclase, a transaminase, an esterase, a hydrolase, a phosphatase, a kinase, a phosphorylase, a polymerase, an elastase, a chitinase and a glucanase, whether natural or synthetic), molecules that stimulates signal transduction, Viral-invasive proteins or a complex toxin derived therefrom, Developmental-arrestive proteins produced in nature by a pathogen or a parasite, a developmental-arrestive protein produced in nature by a plant, or any combination thereof.

The compositions, systems, and methods may be used to identify, screen, introduce or remove mutations or sequences lead to genetic variability that give rise to susceptibility to certain pathogens, e.g., host specific pathogens. Such approach may generate plants that are non-host resistance, e.g., the host and pathogen are incompatible or there can be partial resistance against all races of a pathogen, typically controlled by many genes and/or also complete resistance to some races of a pathogen but not to other races.

In some embodiments, compositions, systems, and methods may be used to modify genes involved in plant diseases. Such genes may be removed, inactivated, or otherwise regulated or modified. Examples of plant diseases include those described in [0045]-[0080] of US20140213619A1, which is incorporated by reference herein in its entirety.

In some embodiments, genes that confer resistance to herbicides may be introduced to plants. Examples of genes that confer resistance to herbicides include genes conferring resistance to herbicides that inhibit the growing point or meristem, such as an imidazolinone or a sulfonylurea, genes conferring glyphosate tolerance (e.g., resistance conferred by, e.g., mutant 5-enolpyruvylshikimate-3-phosphate synthase genes, aroA genes and glyphosate acetyl transferase (GAT) genes, respectively), or resistance to other phosphono compounds such as by glufosinate (phosphinothricin acetyl transferase (PAT) genes from *Streptomyces* species, including *Streptomyces hygroscopicus* and *Streptomyces viridochromogenes*), and to pyridinoxy or phenoxy propionic acids and cyclohexones by ACCase inhibitor-encoding genes), genes conferring resistance to herbicides that inhibit photosynthesis (such as a triazine (psbA and gs+ genes) or a benzonitrile (nitrilase gene), and glutathione S-transferase), genes encoding enzymes detoxifying the herbicide or a mutant glutamine synthase enzyme that is resistant to inhibition, genes encoding a detoxifying enzyme is an enzyme encoding a phosphinothricin acetyltransferase (such as the bar or pat protein from *Streptomyces* species), genes encoding hydroxyphenylpyruvatedioxygenases (HPPD) inhibitors, e.g., naturally occurring HPPD resistant enzymes, and genes encoding a mutated or chimeric HPPD enzyme.

In some embodiments, genes involved in Abiotic stress tolerance may be introduced to plants. Examples of genes include those capable of reducing the expression and/or the activity of poly(ADP-ribose) polymerase (PARP) gene, transgenes capable of reducing the expression and/or the activity of the PARG encoding genes, genes coding for a plant-functional enzyme of the nicotineamide adenine dinucleotide salvage synthesis pathway including nicotinamidase, nicotinate phosphoribosyltransferase, nicotinic acid mononucleotide adenyl transferase, nicotinamide adenine dinucleotide synthetase or nicotine amide phosphoribosyltransferase, enzymes involved in carbohydrate biosynthesis, enzymes involved in the production of polyfructose (e.g., the inulin and levan-type), the production of alpha-1,6 branched alpha-1,4-glucans, the production of alternan, the production of hyaluronan.

In some embodiments, genes that improve drought resistance may be introduced to plants. Examples of genes Ubiquitin Protein Ligase protein (UPL) protein (UPL3), DR02, DR03, ABC transporter, and DREB1A.

Nutritionally Improved Plants

In some embodiments, the compositions, systems, and methods may be used to produce nutritionally improved plants. In some examples, such plants may provide functional foods, e.g., a modified food or food ingredient that may provide a health benefit beyond the traditional nutrients it contains. In certain examples, such plants may provide nutraceuticals foods, e.g., substances that may be considered a food or part of a food and provides health benefits, including the prevention and treatment of disease. The nutraceutical foods may be useful in the prevention and/or treatment of diseases in animals and humans, e.g., cancers, diabetes, cardiovascular disease, and hypertension.

An improved plant may naturally produce one or more desired compounds and the modification may enhance the level or activity or quality of the compounds. In some cases, the improved plant may not naturally produce the compound(s), while the modification enables the plant to produce such compound(s). In some cases, the compositions, systems, and methods used to modify the endogenous synthesis of these compounds indirectly, e.g. by modifying one or more transcription factors that controls the metabolism of this compound.

Examples of nutritionally improved plants include plants comprising modified protein quality, content and/or amino acid composition, essential amino acid contents, oils and fatty acids, carbohydrates, vitamins and carotenoids, functional secondary metabolites, and minerals. In some examples, the improved plants may comprise or produce compounds with health benefits. Examples of nutritionally improved plants include those described in Newell-Mc-Gloughlin, Plant Physiology, July 2008, Vol. 147, pp. 939-953.

Examples of compounds that can be produced include carotenoids (e.g., α-Carotene or β-Carotene), lutein, lycopene, Zeaxanthin, Dietary fiber (e.g., insoluble fibers, β-Glucan, soluble fibers, fatty acids (e.g., ω-3 fatty acids, Conjugated linoleic acid, GLA), Flavonoids (e.g., Hydroxycinnamates, flavonols, catechins and tannins), Glucosinolates, indoles, isothiocyanates (e.g., Sulforaphane), Phenolics (e.g., stilbenes, caffeic acid and ferulic acid, epicatechin), Plant stanols/sterols, Fructans, inulins, fructo-oligosaccharides, Saponins, Soybean proteins, Phytoestrogens (e.g., isoflavones, lignans), Sulfides and thiols such as diallyl sulphide, Allyl methyl trisulfide, dithiolthiones, Tannins, such as proanthocyanidins, or any combination thereof.

The compositions, systems, and methods may also be used to modify protein/starch functionality, shelf life, taste/aesthetics, fiber quality, and allergen, antinutrient, and toxin reduction traits.

Examples of genes and nucleic acids that can be modified to introduce the traits include stearyl-ACP desaturase, DNA associated with the single allele which may be responsible for maize mutants characterized by low levels of phytic acid, Tf RAP2.2 and its interacting partner SINAT2, Tf Dof1, and DOF Tf AtDof1.1 (OBP2).

Modification of Polploid Plants

The compositions, systems, and methods may be used to modify polyploid plants. Polyploid plants carry duplicate copies of their genomes (e.g. as many as six, such as in wheat). In some cases, the compositions, systems, and methods may be can be multiplexed to affect all copies of a gene, or to target dozens of genes at once. For instance, the compositions, systems, and methods may be used to simultaneously ensure a loss of function mutation in different genes responsible for suppressing defenses against a disease. The modification may be simultaneous suppression the expression of the TaMLO-Al, TaMLO-Bl and TaMLO-Dl nucleic acid sequence in a wheat plant cell and regenerating a wheat plant therefrom, in order to ensure that the wheat plant is resistant to powdery mildew (e.g., as described in WO2015109752).

Regulation of Fruit-Ripening

The compositions, systems, and methods may be used to regulate ripening of fruits. Ripening is a normal phase in the maturation process of fruits and vegetables. Only a few days after it starts it may render a fruit or vegetable inedible, which can bring significant losses to both farmers and consumers.

In some embodiments, the compositions, systems, and methods are used to reduce ethylene production. In some examples, the compositions, systems, and methods may be used to suppress the expression and/or activity of ACC synthase, insert a ACC deaminase gene or a functional fragment thereof, insert a SAM hydrolase gene or functional fragment thereof, suppress ACC oxidase gene expression Alternatively or additionally, the compositions, systems, and methods may be used to modify ethylene receptors (e.g., suppressing ETR1) and/or Polygalacturonase (PG). Suppression of a gene may be achieved by introducing a mutation, an antisense sequence, and/or a truncated copy of the gene to the genome.

Increasing Storage Life of Plants

In some embodiments, the compositions, systems, and methods are used to modify genes involved in the production of compounds which affect storage life of the plant or plant part. The modification may be in a gene that prevents the accumulation of reducing sugars in potato tubers. Upon high-temperature processing, these reducing sugars react with free amino acids, resulting in brown, bitter-tasting products and elevated levels of acrylamide, which is a potential carcinogen. In particular embodiments, the methods provided herein are used to reduce or inhibit expression of the vacuolar invertase gene (VInv), which encodes a protein that breaks down sucrose to glucose and fructose.

Reducing Allergens in Plants

In some embodiments, the compositions, systems, and methods are used to generate plants with a reduced level of allergens, making them safer for consumers. To this end, the compositions, systems, and methods may be used to identify and modify (e.g., suppress) one or more genes responsible for the production of plant allergens. Examples of such genes include Lol p5, as well as those in peanuts, soybeans, lentils, peas, lupin, green beans, mung beans, such as those described in Nicolaou et al., Current Opinion in Allergy and Clinical Immunology 2011; 11(3):222), which is incorporated by reference herein in its entirety.

Generation of Male Sterile Plants

The compositions, systems, and methods may be used to generate male sterile plants. Hybrid plants typically have advantageous agronomic traits compared to inbred plants. However, for self-pollinating plants, the generation of hybrids can be challenging. In different plant types (e.g., maize and rice), genes have been identified which are important for plant fertility, more particularly male fertility. Plants that are as such genetically altered can be used in hybrid breeding programs.

The compositions, systems, and methods may be used to modify genes involved male fertility, e.g., inactivating (such as by introducing mutations to) genes required for male fertility. Examples of the genes involved in male fertility include cytochrome P450-like gene (MS26) or the meganuclease gene (MS45), and those described in Wan X et al., Mol Plant. 2019 Mar. 4; 12(3):321-342; and Kim Y J, et al., Trends Plant Sci. 2018 January; 23(1):53-65.

Increasing the Fertility Stage in Plants

In some embodiments, the compositions, systems, and methods may be used to prolong the fertility stage of a plant such as of a rice. For instance, a rice fertility stage gene such as Ehd3 can be targeted in order to generate a mutation in the gene and plantlets can be selected for a prolonged regeneration plant fertility stage.

Production of Early Yield of Products

In some embodiments, the compositions, systems, and methods may be used to produce early yield of the product. For example, flowering process may be modulated, e.g., by mutating flowering repressor gene such as SP5G. Examples of such approaches include those described in Soyk S, et al., Nat Genet. 2017 January; 49(1):162-168.

Oil and Biofuel Production

The compositions, systems, and methods may be used to generate plants for oil and biofuel production. Biofuels include fuels made from plant and plant-derived resources. Biofuels may be extracted from organic matter whose energy has been obtained through a process of carbon fixation or are made through the use or conversion of biomass. This biomass can be used directly for biofuels or can be converted to convenient energy containing substances by thermal conversion, chemical conversion, and biochemical conversion. This biomass conversion can result in fuel in solid, liquid, or gas form. Biofuels include bioethanol and biodiesel. Bioethanol can be produced by the sugar fermentation process of cellulose (starch), which may be derived from maize and sugar cane. Biodiesel can be produced from oil crops such as rapeseed, palm, and soybean. Biofuels can be used for transportation.

Generation of Plants for Production of Vegetable Oils and Biofuels

The compositions, systems, and methods may be used to generate algae (e.g., diatom) and other plants (e.g., grapes) that express or overexpress high levels of oil or biofuels.

In some cases, the compositions, systems, and methods may be used to modify genes involved in the modification of the quantity of lipids and/or the quality of the lipids. Examples of such genes include those involved in the pathways of fatty acid synthesis, e.g., acetyl-CoA carboxylase, fatty acid synthase, 3-ketoacyl_acyl-carrier protein synthase III, glycerol-3-phosphate dehydrogenase (G3PDH), Enoyl-acyl carrier protein reductase (Enoyl-ACP-reductase), glycerol-3-phosphate acyltransferase, lysophosphatidic acyl transferase or diacylglycerol acyltransferase, phospholipid:diacylglycerol acyltransferase, phosphatidate phosphatase, fatty acid thioesterase such as palmitoyl protein thioesterase, or malic enzyme activities.

In further embodiments, it is envisaged to generate diatoms that have increased lipid accumulation. This can be achieved by targeting genes that decrease lipid catabolization. Examples of genes include those involved in the activation of triacylglycerol and free fatty acids, β-oxidation of fatty acids, such as genes of acyl-CoA synthetase, 3-ketoacyl-CoA thiolase, acyl-CoA oxidase activity and phosphoglucomutase.

In some examples, algae may be modified for production of oil and biofuels, including fatty acids (e.g., fatty esters such as acid methyl esters (FAME) and fatty acid ethyl esters (FAEE)). Examples of methods of modifying microalgae include those described in Stovicek et al. Metab. Eng. Comm., 2015; 2:1; U.S. Pat. No. 8,945,839; and WO 2015086795.

In some examples, one or more genes may be introduced (e.g., overexpressed) to the plants (e.g., algae) to produce oils and biofuels (e.g., fatty acids) from a carbon source (e.g., alcohol). Examples of the genes include genes encoding acyl-CoA synthases, ester synthases, thioesterases (e.g., tesA, 'tesA, tesB, fatB, fatB2, fatB3, fatA1, or fatA), acyl-CoA synthases (e.g., fadD, JadK, BH3103, pfl-4354, EAV15023, fadD1, fadD2, RPC_4074, fadDD35, fadDD22, faa39), ester synthases (e.g., synthase/acyl-CoA: diacylglycerol acyltransferase from *Simmondsia chinensis*, *Acinetobacter* sp. ADP, *Alcanivorax borkumensis*, *Pseudomonas aeruginosa*, *Fundibacter jadensis*, *Arabidopsis thaliana*, or *Alcaligenes eutrophus*, or variants thereof).

Additionally or alternatively, one or more genes in the plants (e.g., algae) may be inactivated (e.g., expression of the genes is decreased). For examples, one or more mutations may be introduced to the genes. Examples of such genes include genes encoding acyl-CoA dehydrogenases (e.g., fade), outer membrane protein receptors, and transcriptional regulator (e.g., repressor) of fatty acid biosynthesis (e.g., fabR), pyruvate formate lyases (e.g., pflB), lactate dehydrogenases (e.g., ldhA).

Organic Acid Production

In some embodiments, plants may be modified to produce organic acids such as lactic acid. The plants may produce organic acids using sugars, pentose or hexose sugars. To this end, one or more genes may be introduced (e.g., and overexpressed) in the plants. An example of such genes include LDH gene.

In some examples, one or more genes may be inactivated (e.g., expression of the genes is decreased). For examples, one or more mutations may be introduced to the genes. The genes may include those encoding proteins involved an endogenous metabolic pathway which produces a metabolite other than the organic acid of interest and/or wherein the endogenous metabolic pathway consumes the organic acid.

Examples of genes that can be modified or introduced include those encoding pyruvate decarboxylases (pdc), fumarate reductases, alcohol dehydrogenases (adh), acetaldehyde dehydrogenases, phosphoenolpyruvate carboxylases (ppc), D-lactate dehydrogenases (d-ldh), L-lactate dehydrogenases (l-ldh), lactate 2-monooxygenases, lactate dehydrogenase, cytochrome-dependent lactate dehydrogenases (e.g., cytochrome B2-dependent L-lactate dehydrogenases).

Enhancing Plant Properties for Biofuel Production

In some embodiments, the compositions, systems, and methods are used to alter the properties of the cell wall of plants to facilitate access by key hydrolyzing agents for a more efficient release of sugars for fermentation. By reducing the proportion of lignin in a plant the proportion of cellulose can be increased. In particular embodiments, lignin biosynthesis may be downregulated in the plant so as to increase fermentable carbohydrates.

In some examples, one or more lignin biosynthesis genes may be down regulated. Examples of such genes include 4-coumarate 3-hydroxylases (C3H), phenylalanine ammonia-lyases (PAL), cinnamate 4-hydroxylases (C4H), hydroxycinnamoyl transferases (HCT), caffeic acid O-methyltransferases (COMT), caffeoyl CoA 3-O-methyltransferases (CCoAOMT), ferulate 5-hydroxylases (F5H), cinnamyl alcohol dehydrogenases (CAD), cinnamoyl CoA-reductases (CCR), 4-coumarate-CoA ligases (4CL), monolignol-ligninspecific glycosyltransferases, and aldehyde dehydrogenases (ALDH), and those described in WO 2008064289.

In some examples, plant mass that produces lower level of acetic acid during fermentation may be reduced. To this end, genes involved in polysaccharide acetylation (e.g., Cas1L and those described in WO 2010096488) may be inactivated.

Other Microorganisms for Oils and Biofuel Production

In some embodiments, microorganisms other than plants may be used for production of oils and biofuels using the compositions, systems, and methods herein. Examples of the microorganisms include those of the genus of *Escherichia*, *Bacillus*, *Lactobacillus*, *Rhodococcus*, *Synechococcus*, *Synechocystis*, *Pseudomonas*, *Aspergillus*, *Trichoderma*, *Neurospora*, *Fusarium*, *Humicola*, *Rhizomucor*, *Kluyveromyces*, *Pichia*, *Mucor*, *Myceliophthora*, *Penicillium*, *Phanerochaete*, *Pleurotus*, *Trametes*, *Chrysosporium*, *Saccharomyces*, *Stenotrophomonas*, *Schizosaccharomyces*, *Yarrowia*, or *Streptomyces*.

Plant Cultures and Regeneration

In some embodiments, the modified plants or plant cells may be cultured to regenerate a whole plant which possesses the transformed or modified genotype and thus the desired phenotype. Examples of regeneration techniques include those relying on manipulation of certain phytohormones in a tissue culture growth medium, relying on a biocide and/or herbicide marker which has been introduced together with the desired nucleotide sequences, obtaining from cultured protoplasts, plant callus, explants, organs, pollens, embryos or parts thereof.

Detecting Modifications in the Plant Genome-Selectable Markers

When the compositions, systems, and methods are used to modify a plant, suitable methods may be used to confirm and detect the modification made in the plant. In some examples, when a variety of modifications are made, one or more desired modifications or traits resulting from the modifications may be selected and detected. The detection and confirmation may be performed by biochemical and molecular biology techniques such as Southern analysis, PCR, Northern blot, S1 RNase protection, primer-extension or reverse transcriptase-PCR, enzymatic assays, ribozyme activity, gel electrophoresis, Western blot, immunoprecipitation, enzyme-linked immunoassays, in situ hybridization, enzyme staining, and immunostaining.

In some cases, one or more markers, such as selectable and detectable markers, may be introduced to the plants. Such markers may be used for selecting, monitoring, isolating cells and plants with desired modifications and traits. A selectable marker can confer positive or negative selection and is conditional or non-conditional on the presence of external substrates. Examples of such markers include genes and proteins that confer resistance to antibiotics, such as hygromycin (hpt) and kanamycin (nptII), and genes that confer resistance to herbicides, such as phosphinothricin (bar) and chlorsulfuron (als), enzyme capable of producing or processing colored substances (e.g., the β-glucuronidase, luciferase, B or C1 genes).

Applications in Fungi

The compositions, systems, and methods described herein can be used to perform efficient and cost effective gene or genome interrogation or editing or manipulation in fungi or fungal cells, such as yeast. The approaches and applications in plants may be applied to fungi as well.

A fungal cell may be any type of eukaryotic cell within the kingdom of fungi, such as phyla of Ascomycota, Basidiomycota, Blastocladiomycota, Chytridiomycota, Glomeromycota, Microsporidia, and Neocallimastigomycota. Examples of fungi or fungal cells in include yeasts, molds, and filamentous fungi.

In some embodiments, the fungal cell is a yeast cell. A yeast cell refers to any fungal cell within the phyla Ascomycota and Basidiomycota. Examples of yeasts include budding yeast, fission yeast, and mold, *S. cerevisiae, Kluyveromyces marxianus, Issatchenkia orientalis, Candida* spp. (e.g., *Candida albicans*), *Yarrowia* spp. (e.g., *Yarrowia lipolytica*), *Pichia* spp. (e.g., *Pichia pastoris*), *Kluyveromyces* spp. (e.g., *Kluyveromyces lactis* and *Kluyveromyces marxianus*), *Neurospora* spp. (e.g., *Neurospora crassa*), *Fusarium* spp. (e.g., *Fusarium oxysporum*), and *Issatchenkia* spp. (e.g., *Issatchenkia orientalis, Pichia kudriavzevii* and *Candida acidothermophilum*).

In some embodiments, the fungal cell is a filamentous fungal cell, which grow in filaments, e.g., hyphae or mycelia. Examples of filamentous fungal cells include *Aspergillus* spp. (e.g., *Aspergillus niger*), *Trichoderma* spp. (e.g., *Trichoderma reesei*), *Rhizopus* spp. (e.g., *Rhizopus oryzae*), and *Mortierella* spp. (e.g., *Mortierella isabellina*).

In some embodiments, the fungal cell is of an industrial strain. Industrial strains include any strain of fungal cell used in or isolated from an industrial process, e.g., production of a product on a commercial or industrial scale. Industrial strain may refer to a fungal species that is typically used in an industrial process, or it may refer to an isolate of a fungal species that may be also used for non-industrial purposes (e.g., laboratory research). Examples of industrial processes include fermentation (e.g., in production of food or beverage products), distillation, biofuel production, production of a compound, and production of a polypeptide. Examples of industrial strains include, without limitation, JAY270 and ATCC4124.

In some embodiments, the fungal cell is a polyploid cell whose genome is present in more than one copy. Polyploid cells include cells naturally found in a polyploid state, and cells that has been induced to exist in a polyploid state (e.g., through specific regulation, alteration, inactivation, activation, or modification of meiosis, cytokinesis, or DNA replication). A polyploid cell may be a cell whose entire genome is polyploid, or a cell that is polyploid in a particular genomic locus of interest. In some examples, the abundance of guide RNA may more often be a rate-limiting component in genome engineering of polyploid cells than in haploid cells, and thus the methods using the CRISPR system described herein may take advantage of using certain fungal cell types.

In some embodiments, the fungal cell is a diploid cell, whose genome is present in two copies. Diploid cells include cells naturally found in a diploid state, and cells that have been induced to exist in a diploid state (e.g., through specific regulation, alteration, inactivation, activation, or modification of meiosis, cytokinesis, or DNA replication). A diploid cell may refer to a cell whose entire genome is diploid, or it may refer to a cell that is diploid in a particular genomic locus of interest.

In some embodiments, the fungal cell is a haploid cell, whose genome is present in one copy. Haploid cells include cells naturally found in a haploid state, or cells that have been induced to exist in a haploid state (e.g., through specific regulation, alteration, inactivation, activation, or modification of meiosis, cytokinesis, or DNA replication). A haploid cell may refer to a cell whose entire genome is haploid, or it may refer to a cell that is haploid in a particular genomic locus of interest.

The compositions and systems, and nucleic acid encoding thereof may be introduced to fungi cells using the delivery systems and methods herein. Examples of delivery systems include lithium acetate treatment, bombardment, electroporation, and those described in Kawai et al., 2010, Bioeng Bugs. 2010 November-December; 1(6): 395-403.

In some examples, a yeast expression vector (e.g., those with one or more regulatory elements) may be used. Examples of such vectors include a centromeric (CEN) sequence, an autonomous replication sequence (ARS), a promoter, such as an RNA Polymerase III promoter, operably linked to a sequence or gene of interest, a terminator such as an RNA polymerase III terminator, an origin of replication, and a marker gene (e.g., auxotrophic, antibiotic, or other selectable markers). Examples of expression vectors for use in yeast may include plasmids, yeast artificial chromosomes, 2 plasmids, yeast integrative plasmids, yeast replicative plasmids, shuttle vectors, and episomal plasmids.

Biofuel and Materials Production by Fungi

In some embodiments, the compositions, systems, and methods may be used for generating modified fungi for biofuel and material productions. For instance, the modified fungi for production of biofuel or biopolymers from fermentable sugars and optionally to be able to degrade plant-derived lignocellulose derived from agricultural waste as a source of fermentable sugars. Foreign genes required for biofuel production and synthesis may be introduced in to fungi In some examples, the genes may encode enzymes involved in the conversion of pyruvate to ethanol or another product of interest, degrade cellulose (e.g., cellulase), endogenous metabolic pathways which compete with the biofuel production pathway.

In some examples, the compositions, systems, and methods may be used for generating and/or selecting yeast strains with improved xylose or cellobiose utilization, isoprenoid biosynthesis, and/or lactic acid production. One or more genes involved in the metabolism and synthesis of these compounds may be modified and/or introduced to yeast cells. Examples of the methods and genes include lactate dehydrogenase, PDC1 and PDC5, and those described in Ha, S. J., et al. (2011) Proc. Natl. Acad. Sci. USA 108(2): 504-9 and Galazka, J. M., et al. (2010) Science 330(6000): 84-6; Jakociunas T et al., Metab Eng. 2015 March; 28:213-222; Stovicek V, et al., FEMS Yeast Res. 2017 Aug. 1; 17(5).

Improved Plants and Yeast Cells

The present disclosure further provides improved plants and fungi. The improved and fungi may comprise one or more genes introduced, and/or one or more genes modified by the compositions, systems, and methods herein. The improved plants and fungi may have increased food or feed production (e.g., higher protein, carbohydrate, nutrient or vitamin levels), oil and biofuel production (e.g., methanol, ethanol), tolerance to pests, herbicides, drought, low or high temperatures, excessive water, etc.

The plants or fungi may have one or more parts that are improved, e.g., leaves, stems, roots, tubers, seeds, endosperm, ovule, and pollen. The parts may be viable, nonviable, regeneratable, and/or non-regeneratable.

The improved plants and fungi may include gametes, seeds, embryos, either zygotic or somatic, progeny and/or hybrids of improved plants and fungi. The progeny may be a clone of the produced plant or fungi, or may result from sexual reproduction by crossing with other individuals of the same species to introgress further desirable traits into their offspring. The cell may be in vivo or ex vivo in the cases of multicellular organisms, particularly plants.

Further Applications of the CRISPR-Cas System in Plants

Further applications of the compositions, systems, and methods on plants and fungi include visualization of genetic element dynamics (e.g., as described in Chen B, et al., Cell. 2013 Dec. 19; 155(7):1479-91), targeted gene disruption positive-selection in vitro and in vivo (as described in Malina A et al., Genes Dev. 2013 Dec. 1; 27(23):2602-14), epigenetic modification such as using fusion of Cas and histone-modifying enzymes (e.g., as described in Rusk N, Nat Methods. 2014 January; 11(1):28), identifying transcription regulators (e.g., as described in Waldrip Z J, Epigenetics. 2014 September; 9(9):1207-11), anti-virus treatment for both RNA and DNA viruses (e.g., as described in Price A A, et al., Proc Natl Acad Sci USA. 2015 May 12; 112(19):6164-9; Ramanan V et al., Sci Rep. 2015 Jun. 2; 5:10833), alteration of genome complexity such as chromosome numbers (e.g., as described in Karimi-Ashtiyani R et al., Proc Natl Acad Sci USA. 2015 Sep. 8; 112(36):11211-6; Anton T, et al., Nucleus. 2014 March-April; 5(2):163-72), self-cleavage of the CRISPR system for controlled inactivation/activation (e.g., as described Sugano S S et al., Plant Cell Physiol. 2014 March; 55(3):475-81), multiplexed gene editing (as described in Kabadi A M et al., Nucleic Acids Res. 2014 Oct. 29; 42(19):e147), development of kits for multiplex genome editing (as described in Xing H L et al., BMC Plant Biol. 2014 Nov. 29; 14:327), starch production (as described in Hebelstrup K H et al., Front Plant Sci. 2015 Apr. 23; 6:247), targeting multiple genes in a family or pathway (e.g., as described in Ma X et al., Mol Plant. 2015 August; 8(8):1274-84), regulation of non-coding genes and sequences (e.g., as described in Lowder L G, et al., Plant Physiol. 2015 October; 169(2):971-85), editing genes in trees (e.g., as described in Belhaj K et al., Plant Methods. 2013 Oct. 11; 9(1):39; Harrison M M, et al., Genes Dev. 2014 Sep. 1; 28(17):1859-72; Zhou X et al., New Phytol. 2015 October; 208(2):298-301), introduction of mutations for resistance to host-specific pathogens and pests.

Additional examples of modifications of plants and fungi that may be performed using the compositions, systems, and methods include those described in WO2016/099887, WO2016/025131, WO2016/073433, WO2017/066175, WO2017/100158, WO 2017/105991, WO2017/106414, WO2016/100272, WO2016/100571, WO 2016/100568, WO 2016/100562, and WO 2017/019867.

Methods of Using the CRISPR-Cas Systems in Non-Human Animals

The compositions, systems, and methods may be used to study and modify non-human animals, e.g., introducing desirable traits and disease resilience, treating diseases, facilitating breeding, etc. In some embodiments, the compositions, systems, and methods may be used to improve breeding and introducing desired traits, e.g., increasing the frequency of trait-associated alleles, introgression of alleles from other breeds/species without linkage drag, and creation of de novo favorable alleles. Genes and other genetic elements that can be targeted may be screened and identified. Examples of application and approaches include those described in Tait-Burkard C, et al., Livestock 2.0—genome editing for fitter, healthier, and more productive farmed animals. Genome Biol. 2018 Nov. 26; 19(1):204; Lillico S, Agricultural applications of genome editing in farmed animals. Transgenic Res. 2019 August; 28 (Suppl 2):57-60; Houston R D, et al., Harnessing genomics to fast-track genetic improvement in aquaculture. Nat Rev Genet. 2020 Apr. 16. doi: 10.1038/s41576-020-0227-y, which are incorporated herein by reference in their entireties. Applications described in other sections such as therapeutic, diagnostic, etc. can also be used on the animals herein.

The compositions, systems, and methods may be used on animals such as fish, amphibians, reptiles, mammals, and birds. The animals may be farm and agriculture animals, or pets. Examples of farm and agriculture animals include horses, goats, sheep, swine, cattle, llamas, alpacas, and birds, e.g., chickens, turkeys, ducks, and geese. The animals may be a non-human primate, e.g., baboons, capuchin monkeys, chimpanzees, lemurs, macaques, marmosets, tamarins, spider monkeys, squirrel monkeys, and vervet monkeys. Examples of pets include dogs, cats, horses, wolfs, rabbits, ferrets, gerbils, hamsters, chinchillas, fancy rats, guinea pigs, *canaries*, parakeets, and parrots.

In some embodiments, one or more genes may be introduced (e.g., overexpressed) in the animals to obtain or enhance one or more desired traits. Growth hormones, insulin-like growth factors (IGF-1) may be introduced to increase the growth of the animals, e.g., pigs or salmon (such as described in Pursel V G et al., J Reprod Fertil Suppl. 1990; 40:235-45; Waltz E, Nature. 2017; 548:148). Fat-1 gene (e.g., from *C. elegans*) may be introduced for production of larger ratio of n-3 to n-6 fatty acids may be induced, e.g. in pigs (such as described in Li M, et al., Genetics. 2018; 8:1747-54). Phytase (e.g., from *E. coli*) xylanase (e.g., from *Aspergillus niger*), beta-glucanase (e.g., from *Bacillus licheniformis*) may be introduced to reduce the environmental impact through phosphorous and nitrogen release reduction, e.g. in pigs (such as described in Golovan S P, et al., Nat Biotechnol. 2001; 19:741-5; Zhang X et al., elife. 2018). shRNA decoy may be introduced to induce avian influenza resilience e.g. in chicken (such as described in Lyall et al., Science. 2011; 331:223-6). Lysozyme or lysostaphin may be introduced to induce mastitis resilience e.g., in goat and cow (such as described in Maga E A et al., Foodborne Pathog Dis. 2006; 3:384-92; Wall R J, et al., Nat Biotechnol. 2005; 23:445-51). Histone deacetylase such as HDAC6 may be introduced to induce PRRSV resilience, e.g., in pig (such as described in Lu T., et al., PLoS One. 2017; 12:e0169317). CD163 may be modified (e.g., inactivated or removed) to introduce PRRSV resilience in pigs (such as described in Prather R S et al., Sci Rep. 2017 Oct. 17; 7(1):13371). Similar approaches may be used to inhibit or remove viruses and bacteria (e.g., Swine Influenza Virus (SIV) strains which include influenza C and the subtypes of influenza A known as H1N1, H1N2, H2N1, H3N1, H3N2, and H2N3, as well as pneumonia, meningitis and oedema) that may be transmitted from animals to humans.

In some embodiments, one or more genes may be modified or edited for disease resistance and production traits. Myostatin (e.g., GDF8) may be modified to increase muscle growth, e.g., in cow, sheep, goat, catfish, and pig (such as described in Crispo M et al., PLoS One. 2015; 10:e0136690; Wang X, et al., Anim Genet. 2018; 49:43-51; Khalil K, et al., Sci Rep. 2017; 7:7301; Kang J-D, et al., RSC Adv. 2017; 7:12541-9). Pc POLLED may be modified to induce hornlessness, e.g., in cow (such as described in Carlson D F et al., Nat Biotechnol. 2016; 34:479-81). KISSIR may be modified to induce boretaint (hormone release during sexual maturity leading to undesired meat taste), e.g., in pigs. Dead end protein (dnd) may be modified to induce sterility, e.g., in salmon (such as described in Wargelius A, et al., Sci Rep. 2016; 6:21284). Nano2 and DDX may be modified to induce sterility (e.g., in surrogate hosts), e.g., in pigs and chicken (such as described Park K-E, et al., Sci Rep. 2017; 7:40176; Taylor L et al., Development. 2017; 144:928-34). CD163 may be modified to induce PRRSV resistance, e.g., in pigs (such as described in Whitworth K M, et al., Nat Biotechnol. 2015; 34:20-2). RELA may be modified to induce ASFV resilience, e.g., in pigs (such as described in Lillico S G, et al., Sci Rep. 2016; 6:21645). CD18 may be modified to induce Mannheimia (*Pasteurella*) *haemolytica* resilience, e.g., in cows (such as described in Shanthalingam S, et al., roc Natl Acad Sci USA. 2016; 113:13186-90). NRAMP1 may be modified to induce tuberculosis resilience, e.g., in cows (such as described in Gao Y et al., Genome Biol. 2017; 18:13). Endogenous retrovirus genes may be modified or removed for xenotransplantation such as described in Yang L, et al. Science. 2015; 350:1101-4; Niu D et al., Science. 2017; 357:1303-7). Negative regulators of muscle mass (e.g., Myostatin) may be modified (e.g., inactivated) to increase muscle mass, e.g., in dogs (as described in Zou Q et al., J Mol Cell Biol. 2015 December; 7(6):580-3).

Animals such as pigs with severe combined immunodeficiency (SCID) may generated (e.g., by modifying RAG2) to provide useful models for regenerative medicine, xenotransplantation (discussed also elsewhere herein), and tumor development. Examples of methods and approaches include those described Lee K, et al., Proc Natl Acad Sci USA. 2014 May 20; 111(20):7260-5; and Schomberg et al. FASEB Journal, April 2016; 30(1):Suppl 571.1.

SNPs in the animals may be modified. Examples of methods and approaches include those described Tan W. et al., Proc Natl Acad Sci USA. 2013 Oct. 8; 110(41):16526-31; Mali P, et al., Science. 2013 Feb. 15; 339(6121):823-6.

Stem cells (e.g., induced pluripotent stem cells) may be modified and differentiated into desired progeny cells, e.g., as described in Heo Y T et al., Stem Cells Dev. 2015 Feb. 1; 24(3):393-402.

Profile analysis (such as Igenity) may be performed on animals to screen and identify genetic variations related to economic traits. The genetic variations may be modified to introduce or improve the traits, such as carcass composition, carcass quality, maternal and reproductive traits and average daily gain.

Multiplex Targeting

Cas proteins as defined herein can employ more than one RNA guide without losing activity. This enables the use of the CRISPR enzymes, systems or complexes as defined herein for targeting multiple DNA targets, genes or gene loci, with a single enzyme, system or complex as defined herein. The guide RNAs may be tandemly arranged, optionally separated by a nucleotide sequence such as a direct repeat as defined herein. The position of the different guide RNAs is the tandem does not influence the activity.

In some embodiments, the method includes multiplexed targeting such that multiple targets are targeted by one or more CRISPR-Cas systems. In some embodiments, multiple guides are used to achieve multiplexing and/or more than one CRISPR-Cas system can be used to achieve multiplexing may be used. In some examples, one Cas protein can be included in the system and/or delivered that is associated with or is capable of associating with multiple guides, e.g., at least 2, at least 5, at least 10, at least 15, at least 20, at least 30, at least 40, at least 50, at least 60, at least 70, at least 80, at least 90, at least 100, at least 120, at least 140, at least 160, at least 180, at least 200, at least 220, at least 240, at least 260, at least 280, at least 300, at least 350, at least 400, or at least 500 guides. In some examples, a system herein may comprise a Cas protein and multiple guides, e.g., at least 2, at least 5, at least 10, at least 15, at least 20, at least 30, at least 40, at least 50, at least 60, at least 70, at least 80, at least 90, at least 100, at least 120, at least 140, at least 160, at least 180, at least 200, at least 220, at least 240, at least 260, at least 280, at least 300, at least 350, at least 400, or at least 500 guides.

In some embodiments, the Cas protein can form a part of a CRISPR-system or complex thereof that includes tandemly arranged guide RNAs (gRNAs) comprising a series of 2, 3, 4, 5, 6, 7, 8, 9, 10, 15, 25, 25, 30, or more than 30 guide sequences, each capable of specifically hybridizing to a target sequence in a genomic locus or other polynucleotide of interest in a e.g., a cell. In some embodiments, the functional CRISPR-Cas system or complex binds to the multiple target sequences. In some embodiments, the CRISPR-Cas system or complex can or is capable of edit (ing) multiple target sequences. The multiple target sequences can be composed of a genomic locus and, in some embodiments, editing may result in an alteration of gene expression. In some embodiments, the method includes altering or modifying expression of multiple gene products by introducing or delivering a CRISR-Cas system capable of multiplexing to a cell and/or polynucleotide of interest. The method can include introducing into a cell containing said target nucleic acids, e.g., DNA molecules, or containing and expressing target nucleic acid, e.g., DNA molecules; for instance, the target nucleic acids may encode gene products or provide for expression of gene products (e.g. regulatory sequences). In some more specific embodiments, the CRISPR-Cas system used for multiplex targeting includes a deadCas as described in greater detail elsewhere herein. In some embodiments, each of the guide sequence is at least 16, 17, 18, 19, 20, 25 nucleotides, or between 16-30, or between 16-25, or between 16-20 nucleotides in length. Examples of multiplex genome engineering using CRISPR effector proteins are provided in Cong et al. (Science February 15; 339(6121):819-23 (2013) and other publications cited herein.

Collateral Cas Activity-Based Assays and Uses Thereof

Cas 12's and/or Cas13's non-specific RNase activity (also referred to as collateral nucleic acid cleavage activity) can be leveraged to cleave reporters upon target recognition, allowing for the design of sensitive and specific diagnostics using a Cas 12 and/or Cas13, including single nucleotide variants, detection based on rRNA sequences, screening for drug resistance, monitoring microbe outbreaks, genetic perturbations, and screening of environmental samples, as described, for example, in PCT/US18/054472 filed Oct. 22, 2018 at [0183]-[0327], incorporated herein by reference. Reference is made to WO 2017/219027, WO2018/107129, US20180298445, US 2018-0274017, US 2018-0305773, WO 2018/170340, U.S. application Ser. No. 15/922,837, filed Mar. 15, 2018 entitled "Devices for CRISPR Effector System Based Diagnostics", PCT/US18/50091, filed Sep. 7, 2018 "Multi-Effector CRISPR Based Diagnostic Systems", PCT/US18/66940 filed Dec. 20, 2018 entitled "CRISPR Effector System Based Multiplex Diagnostics", PCT/US18/054472 filed Oct. 4, 2018 entitled "CRISPR Effector System Based Diagnostic", U.S. Provisional 62/740,728 filed Oct. 3, 2018 entitled "CRISPR Effector System Based Diagnostics for Hemorrhagic Fever Detection", U.S. Provisional 62/690,278 filed Jun. 26, 2018 and U.S. Provisional 62/767,059 filed Nov. 14, 2018 both entitled "CRISPR Double Nickase Based Amplification, Compositions, Systems and Methods", U.S. Provisional 62/690,160 filed Jun. 26, 2018 and U.S. Pat. No. 62/767,077 filed Nov. 14, 2018, both entitled "CRISPR/CAS and Transposase Based Amplification Compositions, Systems, And Methods", U.S. Provisional 62/690,257 filed Jun. 26, 2018 and 62/767,052 filed Nov. 14, 2018 both entitled "CRISPR Effector System Based Amplification Methods, Systems, And Diagnostics", U.S. Provisional 62/767,076 filed Nov. 14, 2018 entitled "Multiplexing Highly Evolving Viral Variants With SHERLOCK" and 62/767,070 filed Nov. 14, 2018 entitled "Droplet SHERLOCK." Reference is further made to WO2017/127807, WO2017/184786, WO 2017/184768, WO 2017/189308, WO 2018/035388, WO 2018/170333, WO 2018/191388, WO 2018/213708, WO 2019/005866, PCT/US18/67328 filed Dec. 21, 2018 entitled "Novel CRISPR Enzymes and Systems", PCT/US18/67225 filed Dec. 21, 2018 entitled "Novel CRISPR Enzymes and Systems" and PCT/US18/67307 filed Dec. 21, 2018 entitled "Novel CRISPR Enzymes and Systems", U.S. 62/712,809 filed Jul. 31, 2018 entitled "Novel CRISPR Enzymes and Systems", U.S. 62/744,080 filed Oct. 10, 2018 entitled "Novel Cas12b Enzymes and Systems" and U.S. 62/751,196 filed Oct. 26 2018 entitled "Novel Cas12b Enzymes and Systems", U.S. 715,640 filed August 7, 2-18 entitled "Novel CRISPR Enzymes and Systems", WO 2016/205711, U.S. Pat. No. 9,790,490, WO 2016/205749, WO 2016/205764, WO 2017/070605, WO 2017/106657, and WO 2016/149661, WO2018/035387, WO2018/194963, Cox DBT, et al., RNA editing with CRISPR-Cas13, Science. 2017 Nov. 24; 358(6366):1019-1027; Gootenberg J S, et al., Multiplexed and portable nucleic acid detection platform with Cas13, Cas12a, and Csm6, Science. 2018 Apr. 27; 360(6387):439-444; Gootenberg J S, et al., Nucleic acid detection with CRISPR-Cas13a/C2c2, Science. 2017 Apr. 28; 356(6336):438-442; Abudayyeh 00, et al., RNA targeting with CRISPR-Cas13, Nature. 2017 Oct. 12; 550(7675):280-284; Smargon A A, et al., Cas13b Is a Type VI-B CRISPR-Associated RNA-Guided RNase Differentially Regulated by Accessory Proteins Csx27 and Csx28. Mol Cell. 2017 Feb. 16; 65(4):618-630.e7; Abudayyeh 00, et al., C2c2 is a single-component programmable RNA-guided RNA-targeting CRISPR effector, Science. 2016 Aug. 5; 353(6299):aaf5573; Yang L, et al., Engineering and optimizing deaminase fusions for genome editing. Nat Commun. 2016 Nov. 2; 7:13330, Myrvhold et al., Field deployable viral diagnostics using CRISPR-Cas13, Science 2018 360, 444-448, Shmakov et al. "Diversity and evolution of class 2 CRISPR-Cas systems," Nat Rev Microbiol. 2017 15(3):169-182, each of which is incorporated herein by reference in its entirety.

In some embodiments, the CRISPR-Cas system or component thereof described herein can be configured for use in a detection assay based on the collateral activity of a Cas 13 and/or a Cas 12 effector. In some embodiments, a Cas 13 or a Cas 12 protein is or is coupled to a small Type II-D Cas protein or variant thereof described elsewhere herein. In some embodiments, the Cas is a Cas 13a, Cas 13b, Cas13c, or Cas13d protein.

In some embodiments, the detection construct can be configured for a SHERLOCK (Specific High Sensitivity Enzymatic Reporter UnLOCKing) reaction. For ease of reference, these systems may be referred to herein as SHERLOCK systems and the reactions they facilitate as SHERLOCK reactions. See e.g., Kellner et al. Nat. Protoc. 2019. 14(10):2986-3012, International Patent Publications WO 2018/07129, WO 2018/180340, WO 2019/051318, WO 2019/071051, WO 2019/126577; WO 2019/148206, WO 2020/0060067, WO 2020/006049, WO 2020/006036, US Pubs. 2018/0298445, US 2019-0144929, 2018/0305773 Gootenberg et al. 2017, Science. 356:438-442, Gootenberg et al., 2018. Science. 360:439-444, Myhrvold et al. Science. 360:444-448, Jong et al. Point-of-care testing for COVID-19 using SHERLOCK diagnostics. medRxiv 2020.05.04.20091231; doi: https://doi.org/10.1101/2020.05.04.20091231, Abudayyeh et al., CRISPRJ. 2019. 2(3):165-171 which are each incorporated by reference as if expressed in their entirety herein. If a target molecule is present in a sample, the corresponding guide molecule will guide the CRSIPR Cas/guide complex to the target molecule by hybridizing with the target molecule, thereby triggering the CRISPR effector protein's nuclease activity. This activated CRISPR effector protein will cleave both the target molecule and then non-specifically cleave the linker portion of the detection construct, resulting in a detectable signal.

In some embodiments, the method of screening can include contacting a CRISPR-Cas system or component thereof described herein that includes one or more Cas molecules with collateral nucleic acid cleavage activity and configured as previously described to screen for target polynucleotides by leveraging CRISPR-Cas target recognition and Cas protein collateral nucleic acid cleavage activity upon target recognition with a sample containing polynucleotides and detecting one or more detectable signals (or absence thereof) where at least one of the detectable signals (or absence thereof) indicates the presence of a target polynucleotide. In some embodiments, one or more suitable controls are included.

Devices

The CRISPR-Cas systems or component(s) thereof described herein can be embodied in/on diagnostic devices, particularly those CRISPR-Cas systems and/or component(s) thereof configured for an assay based upon the collateral polynucleotide cleavage activity of a Cas protein.

Such systems and components are described in greater detail elsewhere herein. A number of substrates and configurations of devices capable of defining multiple individual discrete volumes within the device may be used. As used herein "individual discrete volume" refers to a discrete space, such as a container, receptacle, or other arbitrary defined volume or space that can be defined by properties that prevent and/or inhibit migration of target molecules, for example a volume or space defined by physical properties such as walls, for example the walls of a well, tube, or a surface of a droplet, which may be impermeable or semipermeable, or as defined by other means such as chemical, diffusion rate limited, electro-magnetic, or light illumination, or any combination thereof that can contain a target molecule and a indexable nucleic acid identifier (for example nucleic acid barcode). By "diffusion rate limited" (for example diffusion defined volumes) is meant spaces that are only accessible to certain molecules or reactions because diffusion constraints effectively defining a space or volume as would be the case for two parallel laminar streams where diffusion will limit the migration of a target molecule from one stream to the other. By "chemical" defined volume or space is meant spaces where only certain target molecules can exist because of their chemical or molecular properties, such as size, where for example gel beads may exclude certain species from entering the beads but not others, such as by surface charge, matrix size or other physical property of the bead that can allow selection of species that may enter the interior of the bead. By "electro-magnetically" defined volume or space is meant spaces where the electro-magnetic properties of the target molecules or their supports such as charge or magnetic properties can be used to define certain regions in a space such as capturing magnetic particles within a magnetic field or directly on magnets. By "optically" defined volume is meant any region of space that may be defined by illuminating it with visible, ultraviolet, infrared, or other wavelengths of light such that only target molecules within the defined space or volume may be labeled. One advantage to the use of non-walled, or semipermeable discrete volumes is that some reagents, such as buffers, chemical activators, or other agents may be passed through the discrete volume, while other materials, such as target molecules, may be maintained in the discrete volume or space. Typically, a discrete volume will include a fluid medium, (for example, an aqueous solution, an oil, a buffer, and/or a media capable of supporting cell growth) suitable for labeling of the target molecule with the indexable nucleic acid identifier under conditions that permit labeling. Exemplary discrete volumes or spaces useful in the disclosed methods include droplets (for example, microfluidic droplets and/or emulsion droplets), hydrogel beads or other polymer structures (for example poly-ethylene glycol di-acrylate beads or agarose beads), tissue slides (for example, fixed formalin paraffin embedded tissue slides with particular regions, volumes, or spaces defined by chemical, optical, or physical means), microscope slides with regions defined by depositing reagents in ordered arrays or random patterns, tubes (such as, centrifuge tubes, microcentrifuge tubes, test tubes, cuvettes, conical tubes, and the like), bottles (such as glass bottles, plastic bottles, ceramic bottles, Erlenmeyer flasks, scintillation vials and the like), wells (such as wells in a plate), plates, pipettes, or pipette tips among others. In certain embodiments, the compartment is an aqueous droplet in a water-in-oil emulsion. In specific embodiments, any of the applications, methods, or systems described herein requiring exact or uniform volumes may employ the use of an acoustic liquid dispenser.

In certain example embodiments, the device comprises a flexible material substrate on which a number of spots may be defined. Flexible substrate materials suitable for use in diagnostics and biosensing are known within the art. The flexible substrate materials may be made of plant derived fibers, such as cellulosic fibers, or may be made from flexible polymers such as flexible polyester films and other polymer types. Within each defined spot, reagents of the system described herein are applied to the individual spots. Each spot may contain the same reagents except for a different guide RNA or set of guide RNAs, or where applicable, a different detection aptamer to screen for multiple targets at once. Thus, the systems and devices herein may be able to screen samples from multiple sources (e.g. multiple clinical samples from different individuals) for the presence of the same target, or a limited number of target, or aliquots of a single sample (or multiple samples from the same source) for the presence of multiple different targets in the sample. In certain example embodiments, the elements of the systems described herein are freeze dried onto the paper or cloth substrate. Example flexible material based substrates that may be used in certain example devices are disclosed in Pardee et al. *Cell.* 2016, 165(5):1255-66 and Pardee et al. *Cell.* 2014, 159(4):950-54. Suitable flexible material-based substrates for use with biological fluids, including blood are disclosed in International Patent Application Publication No. WO/2013/071301 entitled "Paper based diagnostic test" to Shevkoplyas et al. U.S. Patent Application Publication No. 2011/0111517 entitled "Paper-based microfluidic systems" to Siegel et al. and Shafiee et al. "Paper and Flexible Substrates as Materials for Biosensing Platforms to Detect Multiple Biotargets" Scientific Reports 5:8719 (2015). Further flexible based materials, including those suitable for use in wearable diagnostic devices are disclosed in Wang et al. "Flexible Substrate-Based Devices for Point-of-Care Diagnostics" Cell 34(11):909-21 (2016). Further flexible based materials may include nitrocellulose, polycarbonate, methylethyl cellulose, polyvinylidene fluoride (PVDF), polystyrene, or glass (see e.g., US20120238008). In certain embodiments, discrete volumes are separated by a hydrophobic surface, such as but not limited to wax, photoresist, or solid ink.

In some embodiments, a dosimeter or badge may be provided that serves as a sensor or indicator such that the wearer is notified of exposure to certain microbes or other agents. For example, the systems described herein may be used to detect a particular pathogen. Likewise, aptamer based embodiments disclosed above may be used to detect both polypeptide as well as other agents, such as chemical agents, to which a specific aptamer may bind. Such a device may be useful for surveillance of soldiers or other military personnel, as well as clinicians, researchers, hospital staff, and the like, in order to provide information relating to exposure to potentially dangerous microbes as quickly as possible, for example for biological or chemical warfare agent detection. In other embodiments, such a surveillance badge may be used for preventing exposure to dangerous microbes or pathogens in immunocompromised patients, burn patients, patients undergoing chemotherapy, children, or elderly individuals.

Samples sources that may be analyzed using the systems and devices described herein include biological samples of a subject, or environmental samples. Environmental samples may include surfaces or fluids. The biological samples may include, but are not limited to, saliva, blood, plasma, sera, stool, urine, sputum, mucous, lymph, synovial fluid, spinal fluid, cerebrospinal fluid, a swab from skin or a mucosal membrane, or combination thereof. In an example embodiment, the environmental sample is taken from a solid surface, such as a surface used in the preparation of food or other sensitive compositions and materials.

In other example embodiments, the elements of the systems described herein may be place on a single use substrate, such as swab or cloth that is used to swab a surface or sample fluid. For example, the system could be used to test for the presence of a pathogen on a food by swabbing the surface of a food product, such as a fruit or vegetable. Similarly, the single use substrate may be used to swab other surfaces for detection of certain microbes or agents, such as for use in security screening. Single use substrates may also have applications in forensics, where the CRISPR systems are designed to detect, for example identifying DNA SNPs that may be used to identify a suspect, or certain tissue or cell markers to determine the type of biological matter present in a sample. Likewise, the single use substrate could be used to collect a sample from a patient—such as a saliva sample from the mouth—or a swab of the skin. In other embodiments, a sample or swab may be taken of a meat product on order to detect the presence of absence of contaminants on or within the meat product.

Near-real-time microbial diagnostics are needed for food, clinical, industrial, and other environmental settings (see e.g., Lu T K, Bowers J, and Koeris M S., Trends Biotechnol. 2013 June; 31(6):325-7). In certain embodiments, the present invention is used for rapid detection of foodborne pathogens using guide RNAs specific to a pathogen (e.g., *Campylobacter jejuni, Clostridium perfringens, Salmonella* spp., *Escherichia coli, Bacillus cereus, Listeria monocytogenes, Shigella* spp., *Staphylococcus aureus*, Staphylococcal enteritis, *Streptococcus, Vibrio cholerae, Vibrio parahaemolyticus, Vibrio vulnificus, Yersinia enterocolitica* and *Yersinia pseudotuberculosis, Brucella* spp., *Corynebacterium ulcerans, Coxiella burnetii*, or *Plesiomonas shigelloides*).

In certain embodiments, the device is or comprises a flow strip. For instance, a lateral flow strip allows for RNAse (e.g. C2c2) detection by color. The RNA reporter is modified to have a first molecule (such as for instance FITC) attached to the 5' end and a second molecule (such as for instance biotin) attached to the 3' end (or vice versa). The lateral flow strip is designed to have two capture lines with anti-first molecule (e.g. anti-FITC) antibodies hybridized at the first line and anti-second molecule (e.g. anti-biotin) antibodies at the second downstream line. As the e.g. SHERLOCK reaction flows down the strip, uncleaved reporter will bind to anti-first molecule antibodies at the first capture line, while cleaved reporters will liberate the second molecule and allow second molecule binding at the second capture line. Second molecule sandwich antibodies, for instance conjugated to nanoparticles, such as gold nanoparticles, will bind any second molecule at the first or second line and result in a strong readout/signal (e.g. color). As more reporter is cleaved, more signal will accumulate at the second capture line and less signal will appear at the first line. In certain embodiments, the invention relates to the use of a follow strip as described herein for detecting nucleic acids or polypeptides. In certain embodiments, the invention relates to a method for detecting nucleic acids or polypeptides with a flow strip as defined herein, e.g. (lateral) flow tests or (lateral) flow immunochromatographic assays.

In certain example embodiments, the device is a microfluidic device that generates and/or merges different droplets (i.e. individual discrete volumes). For example, a first set of droplets may be formed containing samples to be screened and a second set of droplets formed containing the elements of the systems described herein. The first and second set of droplets are then merged and then diagnostic methods as described herein are carried out on the merged droplet set. Microfluidic devices disclosed herein may be silicone-based chips and may be fabricated using a variety of techniques, including, but not limited to, hot embossing, molding of elastomers, injection molding, LIGA, soft lithography, silicon fabrication and related thin film processing techniques. Suitable materials for fabricating the microfluidic devices include, but are not limited to, cyclic olefin copolymer (COC), polycarbonate, poly(dimethylsiloxane) (PDMS), and poly(methylacrylate) (PMMA). In one embodiment, soft lithography in PDMS may be used to prepare the microfluidic devices. For example, a mold may be made using photolithography which defines the location of flow channels, valves, and filters within a substrate. The substrate material is poured into a mold and allowed to set to create a stamp. The stamp is then sealed to a solid support, such as but not limited to, glass. Due to the hydrophobic nature of some polymers, such as PDMS, which absorbs some proteins and may inhibit certain biological processes, a passivating agent may be necessary (Schoffner et al. *Nucleic Acids Research*, 1996, 24:375-379). Suitable passivating agents are known in the art and include, but are not limited to, silanes, parylene, n-Dodecyl-b-D-matoside (DDM), pluronic, Tween-20, other similar surfactants, polyethylene glycol (PEG), albumin, collagen, and other similar proteins and peptides.

In certain example embodiments, the system and/or device may be adapted for conversion to a flow-cytometry readout in or allow to all of sensitive and quantitative measurements of millions of cells in a single experiment and improve upon existing flow-based methods, such as the PrimeFlow assay. In certain example embodiments, cells may be cast in droplets containing unpolymerized gel monomer, which can then be cast into single-cell droplets suitable for analysis by flow cytometry. A detection construct comprising a fluorescent detectable label may be cast into the droplet comprising unpolymerized gel monomer. Upon polymerization of the gel monomer to form a bead within a droplet. Because gel polymerization is through free-radical formation, the fluorescent reporter becomes covalently bound to the gel. The detection construct may be further modified to comprise a linker, such as an amine. A quencher may be added post-gel formation and will bind via the linker to the reporter construct. Thus, the quencher is not bound to the gel and is free to diffuse away when the reporter is cleaved by the CRISPR effector protein. Amplification of signal in droplet may be achieved by coupling the detection construct to a hybridization chain reaction (HCR initiators) amplification. DNA/RNA hybrid hairpins may be incorporated into the gel which may comprise a hairpin loop that has a RNase sensitive domain. By protecting a strand displacement toehold within a hairpin loop that has a RNase sensitive domain, HCR initiators may be selectively deprotected following cleavage of the hairpin loop by the CRISPR effector protein. Following deprotection of HCR initiators via toehold mediated strand displacement, fluorescent HCR monomers may be washed into the gel to enable signal amplification where the initiators are deprotected.

An example of microfluidic device that may be used in the context of the invention is described in Hou et al. "Direct Detection and drug-resistance profiling of bacteremias using inertial microfluidics" Lap Chip. 15(10):2297-2307 (2016).

In systems described herein, may further be incorporated into wearable medical devices that assess biological samples, such as biological fluids, of a subject outside the clinic setting and report the outcome of the assay remotely to a central server accessible by a medical care professional. The device may include the ability to self-sample blood, such as the devices disclosed in U.S. Patent Application Publication No. 2015/0342509 entitled "Needle-free Blood Draw to Peeters et al., U.S. Patent Application Publication No. 2015/0065821 entitled "Nanoparticle Phoresies" to Andrew Conrad.

In certain example embodiments, the device may comprise individual wells, such as microplate wells. The size of the microplate wells may be the size of standard 6, 24, 96, 384, 1536, 3456, or 9600 sized wells. In certain example embodiments, the elements of the systems described herein may be freeze dried and applied to the surface of the well prior to distribution and use.

The devices disclosed herein may further comprise inlet and outlet ports, or openings, which in turn may be connected to valves, tubes, channels, chambers, and syringes and/or pumps for the introduction and extraction of fluids into and from the device. The devices may be connected to fluid flow actuators that allow directional movement of fluids within the microfluidic device. Example actuators include, but are not limited to, syringe pumps, mechanically actuated recirculating pumps, electroosmotic pumps, bulbs, bellows, diaphragms, or bubbles intended to force movement of fluids. In certain example embodiments, the devices are connected to controllers with programmable valves that work together to move fluids through the device. In certain example embodiments, the devices are connected to the controllers discussed in further detail below. The devices may be connected to flow actuators, controllers, and sample loading devices by tubing that terminates in metal pins for insertion into inlet ports on the device.

As shown herein the elements of the system are stable when freeze dried, therefore embodiments that do not require a supporting device are also contemplated, i.e., the system may be applied to any surface or fluid that will support the reactions disclosed herein and allow for detection of a positive detectable signal from that surface or solution. In addition to freeze-drying, the systems may also be stably stored and utilized in a pelletized form. Polymers useful in forming suitable pelletized forms are known in the art.

In certain embodiments, the CRISPR effector protein is bound to each discrete volume in the device. Each discrete volume may comprise a different guide RNA specific for a different target molecule. In certain embodiments, a sample is exposed to a solid substrate comprising more than one discrete volume each comprising a guide RNA specific for a target molecule. Not being bound by a theory, each guide RNA will capture its target molecule from the sample and the sample does not need to be divided into separate assays. Thus, a valuable sample may be preserved. The effector protein may be a fusion protein comprising an affinity tag. Affinity tags are well known in the art (e.g., HA tag, Myc tag, Flag tag, His tag, biotin). The effector protein may be linked to a biotin molecule and the discrete volumes may comprise streptavidin. In other embodiments, the CRISPR effector protein is bound by an antibody specific for the effector protein. Methods of binding a CRISPR enzyme has been described previously (see, e.g., US20140356867A1).

The devices disclosed herein may also include elements of point of care (POC) devices known in the art for analyzing samples by other methods. See, for example St John and Price, "Existing and Emerging Technologies for Point-of-Care Testing" (Clin Biochem Rev. 2014 August; 35(3): 155-167).

The present invention may be used with a wireless lab-on-chip (LOC) diagnostic sensor system (see e.g., U.S. Pat. No. 9,470,699 "Diagnostic radio frequency identification sensors and applications thereof"). In certain embodiments, the present invention is performed in a LOC controlled by a wireless device (e.g., a cell phone, a personal digital assistant (PDA), a tablet) and results are reported to said device.

Radio frequency identification (RFID) tag systems include an RFID tag that transmits data for reception by an RFID reader (also referred to as an interrogator). In a typical RFID system, individual objects (e.g., store merchandise) are equipped with a relatively small tag that contains a transponder. The transponder has a memory chip that is given a unique electronic product code. The RFID reader emits a signal activating the transponder within the tag through the use of a communication protocol. Accordingly, the RFID reader is capable of reading and writing data to the tag. Additionally, the RFID tag reader processes the data according to the RFID tag system application. Currently, there are passive and active type RFID tags. The passive type RFID tag does not contain an internal power source but is powered by radio frequency signals received from the RFID reader. Alternatively, the active type RFID tag contains an internal power source that enables the active type RFID tag to possess greater transmission ranges and memory capacity. The use of a passive versus an active tag is dependent upon the particular application.

Lab-on-the chip technology is well described in the scientific literature and consists of multiple microfluidic channels, input or chemical wells. Reactions in wells can be measured using radio frequency identification (RFID) tag technology since conductive leads from RFID electronic chip can be linked directly to each of the test wells. An antenna can be printed or mounted in another layer of the electronic chip or directly on the back of the device. Furthermore, the leads, the antenna and the electronic chip can be embedded into the LOC chip, thereby preventing shorting of the electrodes or electronics. Since LOC allows complex sample separation and analyses, this technology allows LOC tests to be done independently of a complex or expensive reader. Rather a simple wireless device such as a cell phone or a PDA can be used. In one embodiment, the wireless device also controls the separation and control of the microfluidics channels for more complex LOC analyses. In one embodiment, a LED and other electronic measuring or sensing devices are included in the LOC-RFID chip. Not being bound by a theory, this technology is disposable and allows complex tests that require separation and mixing to be performed outside of a laboratory.

In preferred embodiments, the LOC may be a microfluidic device. The LOC may be a passive chip, wherein the chip is powered and controlled through a wireless device. In certain embodiments, the LOC includes a microfluidic channel for holding reagents and a channel for introducing a sample. In certain embodiments, a signal from the wireless device delivers power to the LOC and activates mixing of the sample and assay reagents. Specifically, in the case of the present invention, the system may include a masking agent, CRISPR effector protein, and guide RNAs specific for a target molecule. Upon activation of the LOC, the microfluidic device may mix the sample and assay reagents. Upon mixing, a sensor detects a signal and transmits the results to the wireless device. In certain embodiments, the unmasking agent is a conductive RNA molecule. The conductive RNA molecule may be attached to the conductive material. Conductive molecules can be conductive nanoparticles, conductive proteins, metal particles that are attached to the protein or latex or other beads that are conductive. In certain embodiments, if DNA or RNA is used then the conductive molecules can be attached directly to the matching DNA or RNA strands. The release of the conductive molecules may be detected across a sensor. The assay may be a one step process.

Since the electrical conductivity of the surface area can be measured precisely quantitative results are possible on the disposable wireless RFID electro-assays. Furthermore, the test area can be very small allowing for more tests to be done in a given area and therefore resulting in cost savings. In certain embodiments, separate sensors each associated with a different CRISPR effector protein and guide RNA immobilized to a sensor are used to detect multiple target molecules. Not being bound by a theory, activation of different sensors may be distinguished by the wireless device.

In addition to the conductive methods described herein, other methods may be used that rely on RFID or Bluetooth as the basic low cost communication and power platform for a disposable RFID assay. For example, optical means may be used to assess the presence and level of a given target molecule. In certain embodiments, an optical sensor detects unmasking of a fluorescent masking agent.

In certain embodiments, the device of the present invention may include handheld portable devices for diagnostic reading of an assay (see e.g., Vashist et al., Commercial Smartphone-Based Devices and Smart Applications for Personalized Healthcare Monitoring and Management, Diagnostics 2014, 4(3), 104-128; mReader from Mobile Assay; and Holomic Rapid Diagnostic Test Reader).

As noted herein, certain embodiments allow detection via colorimetric change which has certain attendant benefits when embodiments are utilized in POC situations and/or in resource poor environments where access to more complex detection equipment to readout the signal may be limited. However, portable embodiments disclosed herein may also be coupled with hand-held spectrophotometers that enable detection of signals outside the visible range. An example of a hand-held spectrophotometer device that may be used in combination with the present invention is described in Das et al. "Ultra-portable, wireless smartphone spectrophotometer for rapid, non-destructive testing of fruit ripeness." Nature Scientific Reports. 2016, 6:32504, DOI: 10.1038/srep32504. Finally, in certain embodiments utilizing quantum dot-based masking constructs, use of a hand-held UV light, or other suitable device, may be successfully used to detect a signal owing to the near complete quantum yield provided by quantum dots.

In some embodiments, the device is a lateral flow device. In some embodiments, the lateral flow device can be composed of a CRISPR system and detection construct described elsewhere herein and a lateral flow substrate for carrying out the detection reaction and/or nucleic acid release from the sample.

In some embodiments, the embodiments disclosed herein are directed to a nucleic acid detection system comprising a CRISPR system, one or more guide RNAs designed to bind to corresponding target molecules, a reporter construct (also referred to herein as a detection construct in this context), and optional amplification reagents (discussed in greater detail elsewhere herein) to amplify target nucleic acid molecules and/or detectable signals in a sample. The reporter construct is a molecule that comprises an oligonucleotide component (DNA or RNA) that can be cleaved by an activated CRISPR effector protein. The composition of the oligonucleotide component may be generic i.e. not the same as a target molecule. The reporter construct is configured so that it prevents or masks generation of a detectable positive signal when in the uncleaved configuration, but allows or facilitates generation of a positive detectable signal when cleaved. In the context of the present invention, reporting constructs comprising a first molecule and a second molecule connected by an RNA or DNA nucleic acid linker. Use of an RNA or DNA linker will depend on whether the CRISPR effector protein(s) used have RNA or DNA collateral activity. The first and second molecule are generally part of a binding pair, where the other binding partner is affixed to the lateral flow substrate as described in further detail below. The systems further comprise a detection agent that specifically binds the second molecule and further comprises a detectable label. For ease of reference, these systems may be referred to herein as SHERLOCK systems and the reactions they facilitate as SHERLOCK reactions. The same principles as discussed in connection with SHERLOCK reactions can be applied to other CRISPR-Cas systems with similar targeting and collateral polynucleotide cleavage activities. If a target molecule is present in a sample, the corresponding guide molecule will guide the CRSIPR Cas/guide complex to the target molecule by hybridizing with the target molecule, thereby triggering the CRISPR effector protein's nuclease activity. This activated CRISPR effector protein will cleave both the target molecule and then non-specifically cleave the linker portion of the RNA construct.

In some embodiments, the device can include a lateral flow substrate for detecting a SHERLOCK reaction. Substrates suitable for use in lateral flow assays are known in the art. These may include, but are not necessarily limited to, membranes or pads made of cellulose and/or glass fiber, polyesters, nitrocellulose, or absorbent pads (*J Saudi Chem Soc* 19(6):689-705; 2015). The SHERLOCK system, i.e., one or more CRISPR systems and corresponding reporter constructs are added to the lateral flow substrate at a defined reagent portion of the lateral flow substrate, typically on one end of the lateral flow substrate. Reporting constructs used within the context of the present invention comprise a first molecule and a second molecule linked by an RNA or DNA linker. The lateral flow substrate further comprises a sample portion. The sample portion may be equivalent to, continuous with, or adjacent to the reagent portion. The lateral flow strip further comprises a first capture line, typically a horizontal line running across the device, but other configurations are possible. The first capture region is proximate to and on the same end of the lateral flow substrate as the sample loading portion. A first binding agent that specifically binds the first molecule of the reporter construct is fixed or otherwise immobilized to the first capture region. The second capture region is located towards the opposite end of the lateral flow substrate from the first binding region. A second binding agent is fixed or otherwise immobilized at the second capture region. The second binding agent specifically binds the second molecule of the reporter construct, or the second binding agent may bind a detectable ligand. For example, the detectable ligand may be a particle, such as a colloidal particle, that when it aggregates can be detected visually. The particle may be modified with an antibody that specifically binds the second molecule on the reporter construct. If the reporter construct is not cleaved it will facilitate accumulation of the detectable ligand at the first binding region. If the reporter construct is cleaved the detectable ligand is released to flow to the second binding region. In such an embodiment, the second binding agent is an agent capable of specifically or non-specifically binding the detectable ligand on the antibody on the detectable ligand. Examples of suitable binding agents for such an embodiment include, but are not limited to, protein A and protein G.

Lateral support substrates may be located within a housing (see for example, "Rapid Lateral Flow Test Strips" *Merck Millipore* 2013). The housing may comprise at least one opening for loading samples and a second single opening or separate openings that allow for reading of detectable signal generated at the first and second capture regions.

The SHERLOCK system may be freeze-dried to the lateral flow substrate and packaged as a ready to use device, or the SHERLOCK system may be added to the reagent portion of the lateral flow substrate at the time of using the device. Samples to be screened are loaded at the sample loading portion of the lateral flow substrate. The samples must be liquid samples or samples dissolved in an appropriate solvent, usually aqueous. The liquid sample reconstitutes the SHERLOCK reagents such that a SHERLOCK reaction can occur. The liquid sample begins to flow from the sample portion of the substrate towards the first and second capture regions. Intact reporter construct is bound at the first capture region by binding between the first binding agent and the first molecule. Likewise, the detection agent will begin to collect at the first binding region by binding to the second molecule on the intact reporter construct. If target molecule(s) are present in the sample, the CRISPR effector protein collateral effect is activated. As activated CRISPR effector protein comes into contact with the bound reporter construct, the reporter constructs are cleaved, releasing the second molecule to flow further down the lateral flow substrate towards the second binding region. The released second molecule is then captured at the second capture region by binding to the second binding agent, where additional detection agent may also accumulate by binding to the second molecule. Accordingly, if the target molecule(s) is not present in the sample, a detectable signal will appear at the first capture region, and if the target molecule(s) is present in the sample, a detectable signal will appear at the location of the second capture region.

Specific binding-integrating molecules comprise any members of binding pairs that can be used in the present invention. Such binding pairs are known to those skilled in the art and include, but are not limited to, antibody-antigen pairs, enzyme-substrate pairs, receptor-ligand pairs, and streptavidin-biotin. In addition to such known binding pairs, novel binding pairs may be specifically designed. A characteristic of binding pairs is the binding between the two members of the binding pair.

Oligonucleotide Linkers having molecules on either end may comprise DNA if the CRISPR effector protein has DNA collateral activity (Cpf1 and C2c1) or RNA if the CRISPR effector protein has RNA collateral activity. Oligonucleotide linkers may be single stranded or double stranded, and in certain embodiments, they could contain both RNA and DNA regions. Oligonucleotide linkers may be of varying lengths, such as 5-10 nucleotides, 10-20 nucleotides, 20-50 nucleotides, or more.

In some embodiments, the polypeptide identifier elements include affinity tags, such as hemagglutinin (HA) tags, Myc tags, FLAG tags, V5 tags, chitin binding protein (CBP) tags, maltose-binding protein (MBP) tags, GST tags, poly-His tags, and fluorescent proteins (for example, green fluorescent protein (GFP), yellow fluorescent protein (YFP), cyan fluorescent protein (CFP), dsRed, mCherry, Kaede, Kindling, and derivatives thereof, FLAG tags, Myc tags, AU1 tags, T7 tags, OLLAS tags, Glu-Glu tags, VSV tags, or a combination thereof. Other Affinity tags are well known in the art. Such labels can be detected and/or isolated using methods known in the art (for example, by using specific binding agents, such as antibodies, that recognize a particular affinity tag). Such specific binding agents (for example, antibodies) can further contain, for example, detectable labels, such as isotope labels and/or nucleic acid barcodes such as those described herein.

For instance, a lateral flow strip allows for RNAse (e.g., Cas13a) detection by color. The RNA reporter is modified to have a first molecule (such as for instance FITC) attached to the 5' end and a second molecule (such as for instance biotin) attached to the 3' end (or vice versa). The lateral flow strip is designed to have two capture lines with anti-first molecule (e.g., anti-FITC) antibodies hybridized at the first line and anti-second molecule (e.g. anti-biotin) antibodies at the second downstream line. As the SHERLOCK reaction flows down the strip, uncleaved reporter will bind to anti-first molecule antibodies at the first capture line, while cleaved reporters will liberate the second molecule and allow second molecule binding at the second capture line. Second molecule sandwich antibodies, for instance conjugated to nanoparticles, such as gold nanoparticles, will bind any second molecule at the first or second line and result in a strong readout/signal (e.g., color). As more reporter is cleaved, more signal will accumulate at the second capture line and less signal will appear at the first line. In certain embodiments, the invention relates to the use of a follow strip as described herein for detecting nucleic acids or polypeptides. In certain embodiments, the invention relates to a method for detecting nucleic acids or polypeptides with a flow strip as defined herein, e.g. (lateral) flow tests or (lateral) flow immunochromatographic assays.

In certain example embodiments, a lateral flow device comprises a lateral flow substrate comprising a first end for application of a sample. The first region is loaded with a detectable ligand, such as those disclosed herein, for example a gold nanoparticle. The gold nanoparticle may be modified with a first antibody, such as an anti-FITC antibody. The first region also comprises a detection construct. In one example embodiment, a RNA detection construct and a CRISPR effector system (a CRISPR effector protein and one or more guide sequences configured to bind to one or more target sequences) as disclosed herein. In one example embodiment, and for purposes of further illustration, the RNA construct may comprise a FAM molecule on a first end of the detection construction and a biotin on a second end of the detection construct. Upstream of the flow of solution from the first end of the lateral flow substrate is a first test band. The test band may comprise a biotin ligand. Accordingly, when the RNA detection construct is present it its initial state, i.e. in the absence of target, the FAM molecule on the first end will bind the anti-FITC antibody on the gold nanoparticle, and the biotin on the second end of the RNA construct will bind the biotin ligand allowing for the detectable ligand to accumulate at the first test, generating a detectable signal. Generation of a detectable signal at the first band indicate the absence of the target ligand. In the presence of target, the CRISPR effector complex forms and the CRISPR effector protein is activated resulting in cleavage of the RND detection construct. In the absence of intact RNA detection construct the colloidal gold will flow past the second strip. The lateral flow device may comprise a second band, upstream of the first band. The second band may comprise a molecule capable of binding the antibody-labeled colloidal gold molecule, for example an anti-rabbit antibody capable of binding a rabbit anti-FTIC antibody on the colloidal gold. Therefore, in the presence of one or more targets, the detectable ligand will accumulate at the second band, indicating the presence of the one or more targets in the sample. See also WO 2019/071051, which is incorporated by reference herein.

Knock-Out Screening

The Cas proteins and systems described herein can be used to perform efficient and cost effective functional genomic screens. Such screens can utilize CRISPR-Cas genome wide libraries. Such screens and libraries can provide for determining the function of genes, cellular pathways genes are involved in, and how any alteration in gene expression can result in a particular biological process. An advantage of the present invention is that the system avoids off-target binding and its resulting side effects. This is achieved using systems arranged to have a high degree of sequence specificity for the target DNA.

A genome wide library may comprise a plurality of system guide RNAs, as described herein, comprising guide sequences that are capable of targeting a plurality of target sequences in a plurality of genomic loci in a population of eukaryotic cells. The population of cells may be a population of embryonic stem (ES) cells. The target sequence in the genomic locus may be a non-coding sequence. The non-coding sequence may be an intron, regulatory sequence, splice site, 3' UTR, 5' UTR, or polyadenylation signal. Gene function of one or more gene products may be altered by said targeting. The targeting may result in a knockout of gene function. The targeting of a gene product may comprise more than one guide RNA. A gene product may be targeted by 2, 3, 4, 5, 6, 7, 8, 9, or 10 guide RNAs, preferably 3 to 4 per gene. Off-target modifications may be minimized (See, e.g., DNA targeting specificity of RNA-guided Cas9 nucleases. Hsu, P., Scott, D., Weinstein, J., Ran, F A., Konermann, S., Agarwala, V., Li, Y., Fine, E., Wu, X., Shalem, O., Cradick, T J., Marraffini, L A., Bao, G., & Zhang, F. Nat Biotechnol doi:10.1038/nbt.2647 (2013)), incorporated herein by reference and can be adapted for use with the small Type II-D Cas proteins and systems of the present invention. The targeting may be of about 100 or more sequences. The targeting may be of about 1000 or more sequences. The targeting may be of about 20,000 or more sequences. The targeting may be of the entire genome. The targeting may be of a panel of target sequences focused on a relevant or desirable pathway. The pathway may be an immune pathway. The pathway may be a cell division pathway.

One aspect of the invention comprehends a genome wide library that may comprise a plurality of system guide RNAs that may comprise guide sequences that are capable of targeting a plurality of target sequences in a plurality of genomic loci, wherein said targeting results in a knockout of gene function. This library may potentially comprise guide RNAs that target each and every gene in the genome of an organism.

In some embodiments of the invention the organism or subject is a eukaryote (including mammal including human) or a non-human eukaryote or a non-human animal or a non-human mammal. In some embodiments, the organism or subject is a non-human animal, and may be an arthropod, for example, an insect, or may be a nematode. In some methods of the invention the organism or subject is a plant. In some methods of the invention the organism or subject is a mammal or a non-human mammal. A non-human mammal may be for example a rodent (preferably a mouse or a rat), an ungulate, or a primate. In some methods of the invention the organism or subject is algae, including microalgae, or is a fungus.

The knockout of gene function may comprise introducing into each cell in the population of cells a vector system of one or more vectors comprising an engineered, non-naturally occurring system comprising. a Cas protein and one or more guide RNAs, wherein the components may be same or on different vectors of the system, integrating the components into each cell, wherein the guide sequence targets a unique gene in each cell, wherein the Cas protein is operably linked to a regulatory element, wherein when transcribed, the guide RNA comprising the guide sequence directs sequence-specific binding of a system to a target sequence in the genomic loci of the unique gene, inducing cleavage of the genomic loci by the Cas protein, and confirming different knockout mutations in a plurality of unique genes in each cell of the population of cells thereby generating a gene knockout cell library. The invention comprehends that the population of cells is a population of eukaryotic cells, and in a preferred embodiment, the population of cells is a population of embryonic stem (ES) cells.

The one or more vectors may be plasmid vectors. The vector may be a single vector comprising Cas, a sgRNA, and optionally, a selection marker into target cells. Not being bound by a theory, the ability to simultaneously deliver a Cas and sgRNA through a single vector enables application to any cell type of interest, without the need to first generate cell lines that express Cas. The regulatory element may be an inducible promoter. The inducible promoter may be a doxycycline inducible promoter. In some methods of the invention the expression of the guide sequence is under the control of the T7 promoter and is driven by the expression of T7 polymerase. The confirming of different knockout mutations may be by whole exome sequencing. The knockout mutation may be achieved in 100 or more unique genes. The knockout mutation may be achieved in 1000 or more unique genes. The knockout mutation may be achieved in 20,000 or more unique genes. The knockout mutation may be achieved in the entire genome. The knockout of gene function may be achieved in a plurality of unique genes which function in a particular physiological pathway or condition. The pathway or condition may be an immune pathway or condition. The pathway or condition may be a cell division pathway or condition.

The invention also provides kits that comprise the genome wide libraries mentioned herein. The kit may comprise a single container comprising vectors or plasmids comprising the library of the invention. The kit may also comprise a panel comprising a selection of unique system guide RNAs comprising guide sequences from the library of the invention, wherein the selection is indicative of a particular physiological condition. The invention comprehends that the targeting is of about 100 or more sequences, about 1000 or more sequences or about 20,000 or more sequences or the entire genome. Furthermore, a panel of target sequences may be focused on a relevant or desirable pathway, such as an immune pathway or cell division.

EXAMPLES

Example 1—Exemplary Type II-D Cas Proteins

Exemplary loci for Type II-D Cas proteins and systems and components thereof are shown in FIG. 1. Relevant nucleotide sequences and features are shown and described in e.g., Appendix A and Appendix B of the U.S. Provisional Application Ser. No. 62/962,672, SEQ ID NOs.: 31-133, and Tables 13-15. Exemplary Type II-D Small Cas proteins can be demonstrated in this Example. Such exemplary Cas proteins are referred to in this Example "Small Cas9" (see e.g., Appendix B of U.S. Provisional Application Ser. No. 62/962,672, which is incorporated by reference as if expressed in its entirety herein and SEQ ID NOS. 93-133 and Table 15) and "IntCas9(s)" (see e.g., Appendix A of U.S. Provisional Application Ser. No. 62/962,672, which is incorporated by reference as if expressed in its entirety herein and SEQ ID NOs. 80-92 and Tables 13-14). In other words, both the "Small Cas9" and "IntCas9" proteins and encoding polynucleotides of this Example can be demonstrative of the Type II-D small Cas proteins of the present invention described and provided elsewhere herein. The Small Cas9 and IntCas9(s) demonstrated in this Example are about 950 amino acids or less in size. The exemplary IntCas9s have sizes from 650-776 amino acids (see e.g., Appendix A of U.S. Provisional Application Ser. No. 62/962,672, which is incorporated by reference as if expressed in its entirety herein and SEQ ID NOs. 80-92 and Tables 13-14). The exemplary Small Cas9s (see e.g., Appendix B) are about 950 amino acids or less.

Relevant polynucleotide sequences corresponding to the exemplary Type II-D Small Cas9s and IntCas9s, DR (direct repeats), and TracrRNAs are shown in Tables 13-15 and SEQ ID NOs: 31-133 as shown below and in Appendices A and B to the specification of U.S. Provisional Application Ser. No. 62/962,672, which are incorporated by reference as if expressed in its entirety herein.

The loci for the IntCas9s (about 650-700 amino acids) have a strong CRISPR association and TracrRNA association. The DR length is variable and was between about 29 base pairs and 36 base pairs. IntCas9s were not associated with Cas1, Cas2, Cas4, or Csn2.

TABLE 13

Polynucleotide Sequences Corresponding to Exemplary Type II-D IntCas9, DR, and TracrRNA

| Sequence Name | Name | Sequence | Minimum | Maximum | Length |
|---|---|---|---|---|---|
| 0114922_ 10016519 | IntCas9 | ATGCCGCCCGGATTTTCCTTGTCGACGCCCGGGCGCGGCCGTA TGCTCCCAACTCATGGTGGCCAACGCCCTGGGGATAGACTTGG GCGGCAAGGCAGTGGGGCTTGCTGTGCTGGAGCGACCGGGCA ACCGCGTCCTGTGGTGCGGAACGGTCCACCTCTCCGACAAGAT CAAGGATCTCTACGACCAGCGGCGGACGCTGCGCCGGGCGCG CCGGGGCCGCGGGCGCTACCGCAAGCCGAAGGTCCCCCAGCG AGGCGGAGGATCGGCGGGCCAGACCCAGTGGAGCGGCTTCCG CTACCGGCGCGCCAAGGGCCTCAACCAGTCCCTCCGAACCAAG TGCAAGTACGTCGATCCCGACACGGGCGAGGTCTGCGGAAGG AACACGGCGAAGCGCTCCAATGTCCGGCATCTTTTCCTGGAGG ACATCCTCGGCTTCGCGCCGTTCTCGGACGTCCCGGCCGACTA CAAGCAGGCCATCCGCGACGTGCTGGCGTCGAGGGAAGGCAT CGCAACGCGGAAGCAGCGCCTCGCGGCCGTCCTGAGCCGGAT CGACGTGGACCGGTACCTCAAGAAGCAGATCACGGAGATCTG CTTCGACGAGCGCGGGGGACGCGCGGAGTTCTGCCGGGACCA CATCCCCGCCCGCCACACGCAGACCGCCATCCCCACGCAGGCC GTCTGGCTCCCCCCGTCCATTCGGATCAAGCAGGACTTCCTCCT CAAGCATGTCCGCCAACTTGCCGCCAGCGTCCGCATCGACCGC ATCGTCATCGAGCGCGCCAACTTCGACCTCCAGAAGATCGCGA AGGGAGTGATCGACGATCCCGCGGAGTACCAGCAGGGCGCCC GGTACGGCTTCCGCAACACGCGGATGGCCCTCATGCAGGAGTA CGGCGCCCGTTGCTGCTACTGCGGCAAGAGCGTCGTCGGCGAG AAGTGGCACGTGGACCACATCGACCCGCGGCGTACGGGCGAG ACGAACCGCTGGAACAACCTCGCCATCGCCTGCGAGAAGTGC AACCACAAGAAAGGCGGGCGGACGCCCCTCGATGCGGGCATG GCCTTCGCCGTGGTCGGCGAGACCGTCGCCGGCCGGCGCATCC GGCGCCGGCTGGAGCCCAAGCCGCTCGCCGGAAGCCGTATCA ACAAGTACATGACGCAGACCGACCAGGGCATCCGGATCCTCA AGCGCTCCCTCGCCGAGATCGTCCCCGGCGCGCCCATCGAGGA GACCTACGGCTACGTGACGAGCGCCTGGCGGGACCTGTGGGG CCTGGAGAAGGGCAGGGAGAAGCAGGAGCACCACAACGACG CGATCGTCATCGCCTCCCTGCGCGAAGTTGCCGCCGTCCCCAT CGTCGAGGTCTCACCGCAGGCGATCCGGCAGACCGTCGGCGG CAAGCGCCTCTTCGACCTCAACCCCGTCCAGCGCGCGCGCGAC GCGAAGTACTACCAGCGCGGCCCGGTGGTCGCGGAGGTCGGC GGGATCGCGCCGGCCCAACTGCCTGCGGTCGTGGACGAGCGC AAACGCAAGCTGCTCGCCCGCGAGTTCGCTCGCTACGGCGTCA CGGGCAGGAAGCCGCTGCCGCCGCCGGCGCTGGATCGCCTCCC CTTCAAGAGCGTCCGCCTCCGCAAGCGCGACTGCACGGATGCC AACGTGCGTCGGATGGCGACGGGCCACCGCTTCAAGCTCAGC AACCCCGGCGGCACGCGCGTCAACCAGGCCGTCGTCGTGTATC TCACGTCCGCTGGCAAGCGGGCGTCCTACGCCGTCAAGAACAC CCGGGCCTTCGGCCCGACGGCGCCGCCCGACGACCTCGACCGC GAGCTGTGGCGCTTCCGCCCGGGAGATGCGGTCGCCGATCGGG ACGGCGGCGATCGGGCGCGTCGTCAAGCTCGGCAGCGACG GGACGCTGACACTCGATTCCGGCAAGACACGAAAGGCACACA CGTGCAGCAAGGGAGGTGGTCGAATGACCACGAGCTAG (SEQ ID NO: 31) | 738 | 2730 | 1993 |

TABLE 13-continued

Polynucleotide Sequences Corresponding to Exemplary Type II-D IntCas9, DR, and TracrRNA

| Sequence Name | Name | Sequence | Minimum | Maximum | Length |
|---|---|---|---|---|---|
| | Tracr | GAGGTCAGAAGCAGCCAGAGCGAAGGCCCCCGATGGGGCCTG CCAGGGAACCCAACGAAAGGCGGGACCTGGCCAGCAGCTACG TTTGCAGGAAAGGTCAAGACCTATGCCGGGATGTAGTGATCTC GTCTACCCAGTCCCGGCCTCTTGGAGTCTCGACCCGGAAGATC AACGCCCCAGC (SEQ ID NO: 32) | 3418 | 3598 | 181 |
| | DR | ATTCTGGCCTCTCGCGGGCGTGGGACGATG (SEQ ID NO: 33) | 3162 | 3191 | 30 |
| | DR | CGCGAGGCCTCGCCTGCGTGGGACGATC (SEQ ID NO: 34) | 2735 | 2762 | 28 |
| | DR | ATTCTGGCCTCGCGGGCGTGGGACGATG (SEQ ID NO: 35) | 2796 | 2823 | 28 |
| | DR | ATTCTGGCCTCGCGGGCGTGGGACGATG (SEQ ID NO: 35) | 2857 | 2884 | 28 |
| | DR | ATTCTCGCCTCGCGGGCGTGGGACGATG (SEQ ID NO: 35) | 2918 | 2945 | 28 |
| | DR | ATTCTGGCCTCGCGGGCGTGGGACGATG (SEQ ID NO: 35) | 2979 | 3006 | 28 |
| | DR | ATTCTGGCCTCGCGGGCGTGGGACGATG (SEQ ID NO: 35) | 3040 | 3067 | 28 |
| | DR | ATTCTGGCCTCGCGGGCGTGGGACGATG (SEQ ID NO: 35) | 3101 | 3128 | 28 |
| | DR | ATTCTGGGCTCGCGGGCGTGGGACGATG (SEQ ID NO: 36) | 3225 | 3252 | 28 |
| | DR | ATTCTGGGCTCGCGGGCGTGGGACGATG (SEQ ID NO: 36) | 3287 | 3314 | 28 |
| 0209343_10010378 | IntCas9 | ATGCAAGGACAAAAACTTGGTATAGATTTAGGCGGTAAGCAT GTCGGTCTTGCTGTTGTAAGAACACCGATAAACGAGGTGGCAC ATTACTGCACTATTGAACTCAGAGAAGACATTAAGGATAAGAT GGATGAGAGGAGGTCTCTTCGGAGGGCGAGGAGAAACAGGCT CTGGCATAGGGAAGCGAGGTTTGACAATAGGCAATTAAGGGT GAAAATGCAAATATATTGATAAAGATACAGGCGAAATCTGCGG AGCTAATACTCCAAAGAAATCCAATGTAAAACATCTTCTACTT GAGAATATACTCGTCAATCTTAAAATAGCTGATGAATCTAAAG AGGAAATCAGAAGAAGAGGGCTGGACAGAGACACAAACAAA AGTGAATTACAGACAATCCTTGAGAAATTTTCAATAAATACCT TCCTGAAAAAACAGATTAAAGACATCATTCTTGAAAAGGGGG AAGGGAGGGCTGTCTTTTGCAGAGAGCATATCCCCTTTCATTA TGAACAGGTTGCAACAGAGGCTGAGAGTTTCTGGCTGTCAAAT TCAATAAGGGCTAAACAGGACCAGATACTCTCCCGCCTTAAAA GAATAGCAAAGGATTTTAAGATAGATGAGGTGGTTATTGAAA GGGCGAACTTTGATTTGCAAAAGCTCCAGAGACCTGATGAGAT AGAAGCACCTGAAGATTACATGAAGGGTCCTAACTTCGGGCA CAGAAACAGGTTTGAGGCATTGAAGCAGGAATATGGCAACCG ATGCTGTTTCTGCGGAAAGAAGGGTGGAGATGAAGTAAAGCT GAAGATAGGGCATCTCTATCCGAAGGCTAAAGATGAGATAAA CAGGTGGGAAAACCTTATAACTATATGTGAAAAATGTAATGCG AAGCAGGGTAAAAGGACACCAGAGGAGGCAGGGATGGAATTT GTAATTGTAAAGGAGAAGGTTTTTAATCCTGCAGCAGGAAGG GTAATACCCATAAAAAGAGAACTCAAGCCGAAGCCCATAAAT GAATCAAAGGTTAATAAATATATGACCCATACTGATATTGGCA TAAGGAGGCTCAAAAGAGAAATCCAGAATATTTTTGGAAGCA TACCTATAAGAGAAACATACGGCTATATCACATCGTATTTTAG AAATAAATGGGAGCTTGAAAAAGAACATTATAATGATGCTGT AGTCATAGCCTCTGACAAAGAAGATTTGAATATAAAACCTGTA TTTAAAGATGCAGTCCCTCAGACAATTAAATCATCTATCAAGG GCGGGAAACTCTTTGATACAAATCCCCTCCAGTTTAGTGATGG AAAGTTTTACCAGAACATAACCCTTATAGGCAGAAAGGCAGG GATGCGTTCATCAAAACATAAAAGGGGTCAGAGGAATATCAG GAACTATGCTCAATTTATATGGATGAGATTGAACTTATAACC TCAGAATGGAAGAAAAAGGTTCTCTGCGAATTAAGAGATAAA CTTGGTTATGTAAAAGGAGATAAGAATAAGTCTTTTAAGCCTG AGGAACTGATGAATGCAAATCTGCCTTTCAGGACTGTAACTAT TGACAAAAGGGGTGTAGGAGAATCTTCAACCCGCTTAATCAAT AACAATGTATTCCGTGCCTCAGCTGAAGTAAATACGCATATAA TGGTCTATTCAAATAATGACGGTAGAATGAAGGCATTTGCAGT AAAAAATCCTAAGATATTTAAAGATGCCGGACTCCCTCATGAT TTTCAAAAAAGATATTCATTGTAAAAAAGGGGGATATTGTTA CATGGAAAAAAGTGAAGATGGAATTGCCGTAACAGGCAGGG TGACCAAATGTTTGACAAAAAATGGGGTAATTGATATAAAGG ACATGAATAAATAAAACACTCAGGGAAAAACCCTGTGTATAT TGAAAAGATAGTATCTCCTGAAAGGGGTGCTATTTTTGAGAGA AAATCTCTTTCTGCTCTTTGA (SEQ ID NO: 37) | 4415 | 6391 | 1977 |
| | DR | TTTCAATCTAACACAGTGGCATTAAAAC (SEQ ID NO: 38) | 6696 | 6723 | 28 |
| | DR | TTTCAATCTAACACAGTGGCATTAAAAC (SEQ ID NO: 38) | 6761 | 6788 | 28 |
| 0265297_10050537 | IntCas9 | CTCAAACTCATCGAACTCGAACTCCGGGACGACATCAAGGAC AGAATGGAAGAGCGGAGGGCGCTGCGCAGGCATCGCAGGCAG CGGAAAAGGTACCGCAGGCCCATCGAGCCTGACCGCCAGGCC GGTGTCAGGTCCGCCCCCCCTACCGCAGAGCCTGCGGTCAGA ACCGCGCATCGACCATGAAATGCATGTTCGTCAATCCCGTCAC CGGTGAAAATGCTCCCTCAATGCTCCACTTAAAAAGAACATC CGCCGCGAACTCATGGCAATCACCCTGAAGAATTCGGACATTC CACCGGGTCTGAAAGACAATCTCGTCTCATGTTTCGACCGGAA | 1 | 1836 | 1836 |

TABLE 13-continued

Polynucleotide Sequences Corresponding to Exemplary Type II-D IntCas9, DR, and TracrRNA

| Sequence Name | Name | Sequence | Minimum | Maximum | Length |
|---|---|---|---|---|---|
| | | GCGGAACCCGCCCCTCAGCACTTCTGATCTCATGGCCCAGCTC<br>CGGAAATGGAACGCCCCCTCGCAGACCGTCCGCATGGTTGAAC<br>AACTCCTGCACGGCAACCTGCACGGCCGCTCCGACTACTGCCG<br>CGCGCACCTGCATGCCTGCGCCGGAGACTGGACCGCCGAGCG<br>GCACTCCATGCCCCTTTCGAATTCCGTCCTCGCAAACACTCCT<br>CTCTCGTCAGCCTTCTTAAAAAACTGTCGAAGTATTACAACAT<br>CGACAGAGTCCGCATCGAGGATTCCAACTTCGATCCTGAATTA<br>ATACGTTCCGGCCGCCTGCTGGATTCCGGGGCAGGAGCGGACC<br>GGCCGGATTTCCTCAAGAAAAATACTTTCAAGGCCCTGCAGCA<br>CGAGTATTTAAACCGCTGCTGCTACTGCGGCAGGGACGGAAGC<br>AGTACCCGTCTCGAGATCGAGCACGTGATCCCGAAATCCCTCG<br>GCGGTTCCGACACCTGGGAGAATCTCGTTCTGGCCTGCGGCGA<br>TTGCAACTCCCGGAAGGGCTGGCGGACCCCCGAAACCGCCGG<br>TATGGATTTTCACGTCCTGGAAGGTGTGATTGTCGCCGGCGTG<br>CCGCGCCGGGTTTCTCTGGAACCGGTCCCTTTCGAGCGCTCCC<br>GGACCCGCGGATTCATGGATAAGACCGATCCCGGCAAACGAA<br>CCGTCAGGAAACACCTCCGGCAGGTTTTTCCGCTGGCGGAATT<br>CGAGTTCGACTTCGGCTACAGGACTTCATATCTGAGAAACAAG<br>TGGAACTGGGAAAAATCGCGCTGCTGCGACGCTGCTGTGATCG<br>CGGCCATGGCCGGCGGCGAGATACCAGGCGCTCCCCCCACCAT<br>TCCACTGGAAAAATCAGTTTTGAAATTTAATTCCGGCGGCGGA<br>AAACTGTTCGATACATTTCCCGTTTCAAAAACCGGCGCCGGCT<br>ACGTGCAGGGCCGAACCCTCATAAGCCGCGACGGCAGGTTTG<br>CCAGATTCACGTGGGGGGAAATTAAAAGGGTGGCTTCACCAG<br>GGAAAAAGCGCATCCTTGAAAAACTTAAGGAGAAAGCCGGTG<br>TGGGCGCCGTATCCGACGCAGACCTTATCCCGGACGACCTTTT<br>AGAGACCCTGCCCTTCCGCCGTGTTACCCTCAAGAGAAAGGAT<br>GTCGGCGCTTCCGCCGTCCGCGGGATCAACGGCAATTATTTCA<br>AGGCGGAGCACCCCAACTGGGGAACAGCCGTTTATTTGGATA<br>AAAACGGGAAGAAAAATTTCTTCATGATTAAGAACGCAAGGG<br>TATTTGGAAAAACACAGCCTCCCGAAGATTTTGCCAGGCTCCT<br>TTTCATCATCAGGAAGGGAGACCGTGTGAAGTTCACTTACAAG<br>AACAGGCAGCGGATTGAAAAAGTTTATGCGAACTTCTCGAAC<br>GGGGAGCCTTAAACTGCTTACGGCCGATGGCGAGACAATCATG<br>AAAAGCGCTAAATCCTGCGTCCCCGCCGGTGGACGGGACATA<br>(SEQ ID NO: 39 | | | |
| 0272441_<br>10020685 | IntCas9 | ATGGCAAACGTCCTTGGGATAGACCTGGGCGGCAAGGCGGTG<br>GGGCTGGCCATCGTCCAGCAGCCGGAGAATCAGGTTCTCTGGT<br>GCGGCACCGTTCACCTCTCGGATCGGATCAAGGACCTCTACGA<br>CCAACGCCGCGTTCTGCGCCGCGCCCGGCGCTCCCGCGTCCGC<br>TACCGCAAGCCGAAGGTCCAGCAGCGCGGCGGCGGCTCCGGC<br>GGCCGGGGAACCGAAGGCGCCACCTACTTCTACAAGCGTGCG<br>AAGGGCCTCAATCAGTCGCTCTCCGCAGAAAGTGCAAGTACGTG<br>GACCCCAACACCGGCGAAGTCTGCGGCCGCAACACGCCCAAG<br>CGAGGCAACGTCCGCCACCTGCTGATCGAGGACATCCTGAGCA<br>ACTACTCGCCCTTCGCCACAGTCGATGCAACGCTGAAGCAAGC<br>GATTCGCGACATCCTCGCCAGTCGCGAAGGAATCACTCGCCGC<br>CAGGAGCGGCTCAAGAATGTTCTCGACCTCATCGACATCAACG<br>CCGACCTGAAGAAGCAGATCACCGATATCTTGTTTGGCACAGG<br>CGAGCGCCGCTGTGAGTTCTGCCGCGACCATATCCTCTCCCAC<br>CACGAGCAGACGACAGCGCCGGCCGATCCCCGTTGGCTGCCG<br>CCTTCGATCCGGCTCAAGCAGGAGTTTCTCCTCAAGCAGGTTC<br>GCCGCCTCGCGCACCGTTACCGCATTGACCGCGTCGTCATCGA<br>GCGGGCAAGGTTCGACCTTCAGAAGATCGCCCGCGGCGTCATC<br>GACGACCCGGCCGAGTACCAGCAGGGCCACCGATACGCTTC<br>CGGAACGTCCGGGCGGCCCTCTTTCAGGAGTTCAGCGGCCACT<br>GCTGCTATTGCGGGCGGAGCGTCATTGACAAGAAGTGGCACGT<br>TGACCATGTGGACCCGCGCCGCAAGACGGGGCGGGCGGTG<br>GGACAACCTGGCCGTCGCCTGCGAGTCCTGCAACCACACGAA<br>GGGCGGCCGGTCGCCGCAGGAAGCGGGGATGGCGTTCGCGAC<br>CATCCCGGCGGTCGTCGCGGGGCGCCGCATCCGCCGGTCGCTC<br>GCGCCAAAACCGATTGAAGGCGCCCGCATCCACAAGTATATG<br>ACGCAGACGGACCAGGGCATCCGAATCCTCAAGCGCGAGCTG<br>CGGGAAATCCTTGGGGCGTCGAGATCGACGAGACGTTCGGA<br>TACGTCACGAGCGCCTGGCGAGACCTGTGGGAGTTACCCAAG<br>GGGCGCGAGACGAACGAACACCACAACGACGCCATCGTGATC<br>GCGGCCAACCTCACGCCGGATGCCCGCCCCAAGCTCGACGGC<br>GAGCCGGAAGCCGTCCGGCAGTTGATCGGCGGCAAGCGACTG<br>TACGATCAGAACCCCGTTTCCCGGCGGGGCGACGGGAAGTACT<br>ACCAGCGTCAGCCGGTGCTGGCCGAGCAAGGCGGCATCACGC<br>GCCGGCAGCTTCGCCAAGTGGTGGACGAGCGCAGGCGACGTA<br>TCCTCGCCGCCGCGTTCGAGTACCACGGCGTCAAGGGCAACAA<br>GACGCTGCCGCCCGCCGCGCTCCAGCAGTTGCCATTCAAGAGC | 4333 | 6270 | 1938 |

TABLE 13-continued

Polynucleotide Sequences Corresponding to Exemplary Type II-D IntCas9, DR, and TracrRNA

| Sequence Name | Name | Sequence | Minimum | Maximum | Length |
|---|---|---|---|---|---|
| | Tracr | GTGCGGCTGCGCAAGGCCGACTGCACCGATGAGAACACCCGC GCTCTCCCGGCCCGGAACCGCCGGCATCGCTACAAGATCTCCA ACACAGGCGGAACGCGCGTGAACGAGGCAGTGGCCGTGTATC AAACGACCGGCGGTCGCCGGGCCTGCTACGCCGTGAAGAACC GGCGCGTCTTCGGACGGACGCCGCCCCCGGAGGACCTCGCGA AGGAACTGTGGCGCGTGCGGCCCGGCGATACGCTCCACGATTC GTCGGGCGACGTGCTGGGCGCCGTCGTGAAGCTGGGAAGCAA CGGGACGCTGACGCTGGATAGCGGGAGAACCCGAATGGCTCA CCGATGCCACAGGGCGATCAGCCCCTGA (SEQ ID NO: 40) CGAGTTCGGAAGCAGCCTCAGCGATCCCGAGAGATCGGGAGC CAGGGAACCCAACGAAAGGCGGGACCTGGCCAGAAGCTACGT TTGCAGGACAGCTGAAGACCTATGCCGGGATGTAGTGATCTCG TCTACCCAGTCCCGGCCCCTTGGAGTCTCGGCCCACAAGATCA ACGCCCCAGCG (SEQ ID NO: 41) | 6905 | 7085 | 181 |
| | DR | AACGCTGACCCGCGTGCGTGGGAGTGAT (SEQ ID NO: 42) | 6345 | 6372 | 28 |
| | DR | ATTCCGGACTCGCGTGCGTGGGAGTGAT (SEQ ID NO: 43) | 6406 | 6433 | 28 |
| | DR | ATTCCGGACTCGCGTGCGTGGGAGTGAT (SEQ ID NO: 43) | 6467 | 6494 | 28 |
| | DR | ATTCCGGACTCGCGTGCGTGGGAGTGAT (SEQ ID NO: 43) | 6528 | 6555 | 28 |
| | DR | ATTCCGGACTCGCGTGCGTGGGAGTGAT (SEQ ID NO: 43) | 6590 | 6617 | 28 |
| | DR | ATTCCGGACTCGCGTGCGTGGGAGTGAT (SEQ ID NO: 43) | 6652 | 6679 | 28 |
| | DR | ATTCCGGACTCGCGTGCGTGGGAGTGAT (SEQ ID NO: 43) | 6713 | 6740 | 28 |
| | DR | ATTCCGGACTCGCGTGCGTGGGAGTGAT (SEQ ID NO: 43) | 6774 | 6801 | 28 |
| 0315277_10040887 | IntCas9 | GTGAATACGGAAACGCGAGAGCAGGTGTTGGGGATTGACTTC GGCCCGAAGCACGTGGGAATTGCTCTCGTGGCGAGGGGGGCC TCGTCGGAGGAAGTCCTCTTCGTCGCGGAGGTGCGGCTGAGGG ACCGCAAGTCGCTGCTGGCCGACCGGCGGGCGCTGCGGCGCG GGCGGCGAGGCAGGAAGCGCTACCGCCAGCCCAAGATTCCAC AGCGGGGCGGTGGCGCGACGTCGCAAAGCGGCGAGGAGAGCG AGAGGGGGCGCGCCGCAGCCCCGGAGTATCGTCGCGCCACAG GGCTCAACACAGGGCGACGACGCTGCAAGTTTGTCGACCCCCA GACGGGTGAAATATGCGGGTGGAATACGCCCCGCAAGGCCAA CGTCCGCGACCTCCTGCTGTGGAACATCTGCCGCCACCTTCCG GTGTCTGTCTCCGAGCAGGCGGGGTTCCTCGCTTACGTCAACC AGACGAACCTCCACCGCGCGGAGATACTGGGTGCTCTGCCGGC GGAAGAGCAGGCCCCGCTGGAGGCCGTGTTCTCGCAACAGCG GCGGCCGAAAGACGAGCGGCTGAAGGACCGGCTACGAAGGCT CGGCGTTGACCGGCACCTGCGCTCGCAGGTCACGGACATCGTT GGCATCACCTCTCGCCGGCCGCTCAGCGGGCGGCTGTCTTTCT GCCGCGAGCATTTCCTGCGCCACCACGAGCAGAGCCGCGTTCC CCGGCCCAGCGTGTGGCTCCCGAACACTGTTGAGATGAAGCAA GCGGATGTGCTAAAGGTCTGCCGGCAGGAGGTCGCGCCGCGC TGGCGTGTTGACTGCATAGTGCTAGAGCGGGCCAACTTCGACT TGCAGCTTCTCCGGCAGCAGACCGCCATCGAATGGTCGGTGGA GGACTGGCAGCGCGGCCCGCGGTGGGGCTACCGCAACACCTT CGAGGCGAAGAAGCAGGAGCAGGGGAACCGCTGCGCCTACTG CGGCAGCAAGCCGACGGCGAAGAACCGGCTGAGGCTGGAACT GGAGCACGTCATTCCAGGTGGGGGCGACACGTGGGAGAACCT GGTGCTAAGCTGCCGGAAGTGCAACGAGGGCAAGGGTAATCG CAGCCCTGCGCAGGCCGGCATGCGCTTCTGGACGGACACCGA GACGGGAGAGACGCTCTCCCCGGCGCCGCTCGGCGCCGCGCA CGTTTCCCGCTACATGACCCAGACGGACCAGGGGTGGCGTCGC CTTCAGGCCGCGCTACAGCAGGTCTTCCCCCAGGCCGCAGTCG AGCACACCTGGGGGTACGTGACGAGCTTCTACCGTAACCGCTG GAACCTCCCCAAGAAGCACTTCGTGGACGCGGCCGTCATCGCC AGCTCGCACGAGCTTGAGCGCCCCGTGTCCGTGCCCGAACAGC CCCAGCGGTTTGCTCCGACATCCGGCGGCAAGCAGCTCTTCGA CACGAACCCCCTCTCAAAGCGGCCGGAGGGGCGCTTCGCTCAG AGCAAGGCGATTGTGTGCGAGCAGGGGACGCTCGCCTTCAAA GATGTCGCCAAGGTAGAGAACCCGCGCAAGCGCGCCACGCTT CAGCGCGTCGCGGATGAGGCCACCGCAGCAGCAAAGGCGCGG GGCGAAACCCGCCCACCGCGTTCACCGCTGAAATGCTGCCGA AGATACCATTCAAGTCTGTGCGCCTTGCCAAGCAGGACGCTAG CGACACCAACACACGCCGACTCGGCCGGCATTGGTTCAAGGTC GCAAGCGCCGTGAATATCGCGACCATCGTCTACCAGCTCGACG GGAAGGTTTGCATGCAACTCCAACGCAACCCCGCGGTCTTCCG TCATGACCCTGGCTTGCCGCAGGGGCGCGCGTTGTCGCCACC TTCCGCAAGGGCGACCTGGTGGAGTGTGACGCGGGCCGCGGT CGGGTAACGAAGAACCACAGTAACTGCACTCTCACCGTCGAA CTGCTGGACAGTGGCAAGGAGGTGACGAGGCTGGCGAAGTCG TTCAGGCCGCGGCATGGCTAG (SEQ ID NO: 44) | 1830 | 3848 | 2019 |

TABLE 13-continued

Polynucleotide Sequences Corresponding to Exemplary Type II-D IntCas9, DR, and TracrRNA

| Sequence Name | Name | Sequence | Minimum | Maximum | Length |
|---|---|---|---|---|---|
| | Tracr | GAAGGGCGAAAGCAGCCCAGCCAAGTCTCCGCCCATGGCGGA GCACGGGAAACCGGTGGGGAAACCCGGCCGGCCACCGTAAGG AGGCACGTTTGGGGAACAGGTAGGGGTAACCCTGAGTGCAAC CTGGGGTGCACCTTCAGCTCCAGGCTCTGCAAGGCTCGGCCCA GAGGATTAACGCCCTAAT (SEQ ID NO: 45) | 1548 | 1734 | 187 |
| | DR | TTTCGCCCTCGCATTGGTGGACAGCACG (SEQ ID NO: 46) | 814 | 841 | 28 |
| | DR | TTTCGCCCTCGCATTGGTGGACAGCACG (SEQ ID NO: 46) | 878 | 905 | 28 |
| | DR | TTTCGCCCTCGCATTGGTGGACAGCACG (SEQ ID NO: 46) | 939 | 966 | 28 |
| | DR | TTTCGCCCTCGCATTGGTGGACAGCACC (SEQ ID NO: 47) | 1000 | 1027 | 28 |
| | DR | TTTCGCCCTCGCATTGGTGGACAGCACT (SEQ ID NO: 48) | 1062 | 1089 | 28 |
| | DR | TTTCGCCCTCGCATTGGTGGACAGCACT (SEQ ID NO: 48) | 1125 | 1152 | 28 |
| | DR | TTTCGCCCTCGCATTGGTGGACAGCACG (SEQ ID NO: 46) | 1189 | 1216 | 28 |
| | DR | TTTCGCCCTCGCATTGGTGGACAGCACG (SEQ ID NO: 46) | 1250 | 1277 | 28 |
| | DR | TTTCGCCCTCGCATTGGTGGACAGCACG (SEQ ID NO: 46) | 1311 | 1338 | 28 |
| | DR | TTTCGCCCTCGCATTGGTGGACAGCACG (SEQ ID NO: 46) | 1372 | 1399 | 28 |
| | DR | TTTCGCCCTCGCATTGGTGGACAGCACG (SEQ ID NO: 46) | 1433 | 1460 | 28 |
| 0315279_10036605 | IntCas9 | ATGGAGAACGTCCTCGGGATAGACCTTGGTGGGAAAGCGGTC GGGCTGGCGGTAGTCGAGCAGCCCTCCAACCGCGTCCAGTGGT GCGGGACCGTAAGACTCTCGGACAAGATCAAGGACCTCTACG ACCTTCGGCGAACCCTCCGCCGCGCCAGGCGAAGCCGGGTGC GTTATCGAAAGCCCAAGGTCGCCGAAAGAGGAGGCGGGGCCG GGGGGAAAGGCGAGGAGGGGGCGACCTACTTCTACCGGAAAG CCAAAGGGCTGAATCAGTCGCTGCGGACAAAGTGCAAGTACG TCGATCCCCAGACGGGAGAAGTCTGTGGAAAGAACACGCCCC AGATGGCCAATGTCCGCCACCTCCTCCTGGAGGACATACTCGG CTTTGCGCCCTTTGCCCCGGTGGGGAGGACTGCAAGCAGGCC ATCCGAGACATCCTGGCCTCGCAGGACGGCGACGCGCGACGC CGGGAACGCCTCGAGAACGTCCTGGGGCTGATCGATCTGTCCG AATACCTCGAGGAGCAGATCAAGGACATCATCTTCGGGAAGG GCGACGGGCGTGCCCAGTTCTGCCGCTCGCACATCCTGGGCCA CCCACTCGCAGACCGAGACTCCCAAGCAGGCCGCGTGGTTGCCG CCATCGCTGAAGCTCAAGCAGGATTTCATCCTCAAGGTCATCC GCGAGCGGGGCAAGCCTTGCCGCATCGATCGAATAATAATCG AGCGGGCGAACTTCGACCTCCAGAAGATCGCGCGCGGGGTGA TCGAAGACCCGCGCGAGTACCAGCAAGGGTATCGCTACGGAT TTCGCAATACCCGTGCGGCGCTGATGCAGGAATACGGGGCGA GGTGTTGTTATTGCGGTAAGAGCGTGGCGGGGCAGAAATGGC ACATCGACCACGTCGATCCGCGCAGGACGGGCGAGATCAACC GCTGGGACAACCTCGCCATAGCCTGTGAAAAGTGCAATCACA GCAAAGGCGGGAAGACCCCCAAGGACGCGGGCATGCGCTTCG CGGTGGTGACGGAGAAGGTCGCTGGGCGCAAGATACGCCGCT CCCTGGCCCCGAAGCCCGTCGAGGGCACCCGCATTCACAAGTA CATGACCCAGACCGACCAGGGCATAAACATGCTAAAGAACGC TCTGAGGGAAATCTTCCCCGCTGCTCCCATCGAGGAGACCTTC GGCTACGAGACCGCCGCCTGGCGGGACCTGTGGGGGCTGGAG AAGGGCAAGGAAAAAGGCGAGCACCACAACGATGCCATCGTC ATCGCTTCAGCCGTGTCCCGGAAGGGATTCCCAAGGCAGACG CGCAGCCCGAGGCAATATCGCAGACCGTTGGTGGGAAGCGCC TCTTCGATCTCAACCCGGTCTCCCGCTCGCCCAACGGGCGTTA CTACCAGAGAACGCCGGTTTTGGCCGAATCCGGGGGGATAACT CCCAGGCAACTCCCCGCCGTGGTGGACCAGCGCAAGCGGAAG CTCCTGGCACGCGAGTTCGAACGCTACGGGATCGAGGGGAAC AAGAAACTCCCGGACCGGGCCCGGGAGCGCCTGCCCTTCAAG AGCGTCTTGCTGCTCAAGCGGGACTGCGCGGACGGGAATGTGC GCCGGATGAGAACCGGTCATTCCTTCAAGGTCTCCAATGCCGG CGGAACCAGGGTCAACGAAGCGGTAATCGTCTACGAGAACCT TTTGGGGAAACTATCCTGTTACCCGCTCAAGAACCCCCGGGCC TTCGGGCCTACGAGACCACCGGATGATTTCAAGAGGGAATTGT TCCGATTCCGTGCAGGCGACAGAATCGTTGACCTCAACGGAAG GTCCCTCGGGGAGGTTGTGGAGTTTGGGAGCGACGGCAGGTTG ACAACAGACAAAGGACATAACACAATAGCACACAGGTGCAGA CGGGGGAGTTAG (SEQ ID NO: 49) | 1421 | 3340 | 1920 |
| | Tracr | CGAGGTCGAAAGCAGCCACAGCGAAGGCCCCGCAAGGGCGCC TGCCGGAGAATCCAACGAAAGGCGGAATCCGGCCACGAGCTA CGTTTGCAGGGAAGCCTAAGACCTATGCCGGGATGTAGTGACT CGTCTACCCAGCCCCGGCCTCTTGGAGTCTCGGCCCGGAAGAT CAACGCCCTCCCC (SEQ ID NO: 50) | 4110 | 4292 | 183 |
| | DR | CTGCGAGTCCTCGCGAGCATGGGATTGAT (SEQ ID NO: 51) | 3427 | 3454 | 28 |
| | DR | ATTTCGGCCTCGCGAGCGTGGGATTGAT (SEQ ID NO: 52) | 3488 | 3515 | 28 |
| | DR | ATTTCGGGCTCGCGAGCATGGGATTGAT (SEQ ID NO: 53) | 3550 | 3577 | 28 |
| | DR | ATTTCGGCCTCGCGAGCATGGGATTGAT (SEQ ID NO: 54) | 3611 | 3638 | 28 |
| | DR | ATTTCGGCCTCGCGAGCATGGGATTGAT (SEQ ID NO: 54) | 3674 | 3701 | 28 |
| | DR | ATTTCGGCCTCGCGAGCATGGGATTGAT (SEQ ID NO: 54) | 3737 | 3764 | 28 |

TABLE 13-continued

Polynucleotide Sequences Corresponding to Exemplary Type II-D IntCas9, DR, and TracrRNA

| Sequence Name | Name | Sequence | Minimum | Maximum | Length |
|---|---|---|---|---|---|
| | DR | ATTTCGGCCTCGCGAGCATGGGATTGAT (SEQ ID NO: 54) | 3798 | 3825 | 28 |
| | DR | ATTTCGGCCTCGCGAGCATGGGATTGAT (SEQ ID NO: 54) | 3860 | 3887 | 28 |
| | DR | ATTTCGGCCTCGCGAGCATGGGATTGAT (SEQ ID NO: 54) | 3921 | 3948 | 28 |
| | DR | ATTTCGGCCTCGCGAGCATGGGATTGAT (SEQ ID NO: 54) | 3983 | 4010 | 28 |
| 0315281_10072405 | IntCas9 | TTGCATCATAAGCAGCTGACAGTAGAAGCTGAAAGTTCGTGGC TATCCAACAGCATCAGGGCAAAACAAGACCAAGTCATATCAC ATCTTGAGAAGTTAGCGAAACATTTTTCAATAAGTGAAGTGAT TCTGGAAAGAGCAAACTTTGACCTTCAGAAGATACAGGGAAT GATTGAGAATCCTGATGATTATATGCATGGGTTCAATTTCGGT CACAGAAACAGGTTTGAAGCTTTGAAGCAGGAATACGGAAAT CGTTGCTGCTTCTGTGGGCAAACAGGTGGCGAAAAAGTAAGG CTTCAAATCGGACATGTTTATCCGAAAGCAAAGGAAGAAATTA ACCGATGGGAAAATCTCATTACTATTTGTGAGAAATGCAACAT CAAACAAGGCGGAAGAACACCTGACGAAGCAGGGATGAAGTT TGCAGTAGTAAAAGAGAAAGTCTTCAATCCAGTACTTGGACAA ATAATAACTGCATCAAGAACGCTTTCACCGAAACCACTCAGTG AGTCTAAAATAAATAAATACATGACACATACGGATATAGGAA TAAGAAAACTAAAGAAGCAAATTAATTCAATGTTTGGAGATAT ACCTATAAAAGAAACCTTTGGTTATATAACATCTTATTATCGA AATCACTGGGGATTGGATAAAGAGCATTACAATGATGCGATA GTTGTCGCATCTGAAAAAGGTGATTTAAACAAGAAGCCTCAAT CCCCATATATAAAGCCCGTTGTTCAATCCGAAGATTAAAGG CGAGAAACTTTTCGACACCAATCCTCTACAACATAAGAATGGC AAGTTCTATCAACAAATATCTTTGATAGGCAGAAAAAAGAGTG CTCGTTCTTCAAATCATAAAGCTGGACAGAGAAAAATAAGGG CATATAATGCATTACGGATTGACCAGATTGAGTTGATTATGTC TGCATGGAAACGGAAAATACTTGATGAGTTAAGAGAGAAACT CGGCTATATGAAGGGAGACAGGAAAAAAATACTTCAAGCCCGA TGACATCATAAATGCAAATCTGCCATTCAGAACTGTGACCATA GAAAAACTAGGAGTTGGCGAGAGTGCGGTAAGAAAAAATCAAG AATAATGTTTTTCGTGTCGCTTCTGATGTCAATACCCATATAAT GGTTTACTCCACGCCTGACTCAAAAATGAAAGCGATTCCTATC AAGAATACAAGAATATTTAAAGATGTTGACATGCATAGAGATT TCTCCAAGAAACTTTTCATAGTAAAAAAAGGAGATGTAGTCTG CTGGAAAAACAAAGGAGTCGAGATTACAGGTAAGGTAATGAA ATGCTTGACAAAGGGTGCGAGCATTGATATAAAGGATATGGA TTCTGACAAGACCTACAGCGCTAAGAACCCTGTTTGTATTCAG TCGGTTCGTTCCTCTGAAGGTAAATTGCTCTTTGAAAATAGAA ACTCAAGATTGAAAACCGCC (SEQ ID NO: 55) | 26 | 1495 | 1470 |
| | DR | TTTCAATCTCACATTAGTGGCATTTAAAG (SEQ ID NO: 56) | 1725 | 1753 | 29 |
| | DR | TTTCAATCTCACATTAGTGGCATTTAAAG (SEQ ID NO: 56) | 1791 | 1819 | 29 |
| | DR | TTTCAATCTCACATTAGTGGCATTTAAAG (SEQ ID NO: 56) | 1856 | 1884 | 29 |
| | DR | TTTCAATCTCACATTAGTGGCATTTAAAG (SEQ ID NO: 56) | 1923 | 1951 | 29 |
| | DR | TTTCAATCTCACATTAGTGGCATTTAAAG (SEQ ID NO: 56) | 1991 | 2019 | 29 |
| | DR | TTTCAATCTCACATTAGTGGCATTTAAAG (SEQ ID NO: 56) | 2058 | 2086 | 29 |
| 0315285_10000442 | IntCas9 | ATGCCGAACGTCATGGGGATAGATTTGGGCGGCAAGGCCGTC GGGCTGGCTATCGTCCAGCAGCCGGAGAATCGCACTCTATGGT GCGGAACAATCCATTTGTCGGACAAGATCAAGGACCTCTACGA TCTCCGCCGTACGCTCCGCCGAGCCCGCCGCAGCCGCGTGAGA TACCGTAAGCCCAAAGTCCCCCAGCGCGGCGGCGGGTCCGCC GGCCAATCGCAATGGAGCGGCTACTCTTACCGCCGCGCCAAAG GACTGAACCAATCCCTTCGGACCAAGTGCAAGCACGTCGATTC TGAAACCGGCGAGGTCTGCGACAAGAACACCCCGAAGAACGC CAACGTCCGCCACCTGTTCCTCGACGACATCCTTAGCTACGCC CCATTTCAAGCCGTGCCCGATGACCACAAGCAGTCCATCCGCG AGGTCCTCACCAGCCGCGATGGTATAGCCAGCCGGCGCGAGC GTCTGGCGGATCTCCTTGACCGGCTCACCGTCAAAGCCTATCT CAAGAAGCAGATAAAGGACATCTGTTTCAATGACCTCGACGG CCGCGCGGAGTTCTGCAGCGACCACATCCTTTGCCACCACGCC CAGACTGACGTGCCCAAACAGTCGGCCTGGCTGCCGCCCTCGA TCCGCCTCAAGCAGGATTTCCTCCTGAAGAACATCCGCGAACT GGCCCAGCTTTTCCACATCGACCGCATCGTTCTAGAGCGGGCC AACTTCGACCTCCAGAAGATCGCCGCCGGCGTGATTGAAGACC CATCAGAGTACCAGCAGGGCTTCCGGTTCGGTTCCCGCAACAC GCGGATGGCCCTGATGCAGGAATACGGCGCGCGTTGCTGCTAC TGCGGCCAGAGCGTCGCCGGCCAGAAATGGCATGTTGACCAC ATCGACCCGCGCCGCTGGGGAGGCCAACCGGTGGCAACC CTGGCCATCGCCTGTGAAAAGTGCAACCACCAAAAGGGAGGC CGCACGCCGAAGGACGCCGGGATGGCCTTCGCCGTCATCTCCG AGAGAGTCGCCGGGCGGATGATACGCCGCTCCCTGGAGCCCC ACCCCATCGAGGGAACCCGGATCAACAAGTACATGACCCAGA CCGACCAGGGCATCCGCATGCTGAAAAACGCCCTCCGGGAGA | 7055 | 8974 | 1920 |

TABLE 13-continued

Polynucleotide Sequences Corresponding to Exemplary Type II-D IntCas9, DR, and TracrRNA

| Sequence Name | Name | Sequence | Minimum | Maximum | Length |
|---|---|---|---|---|---|
| | | TCTTGCCCGGCGCAGAGATCGAGGAGACTTTCGGCTACGTCAC<br>CAGCGCCTGGCGGGAGTTCTGGGGCCTCGAAAAGGGCAAGGA<br>AAAACAAGAGCACCACAACGACGCCATTGTCATCGCCGCCGA<br>CCGCCGCGGCGGCGCGAAGCCCATCGTCGAAATAATTCCACTG<br>GCCAATCGCCAGATCGTGGGCGGCCGCCGCCTGTTCGACCTTA<br>ACCCCGTTCAGCGCGCGCCCGACGGCCGGCATTATCAGCGGAC<br>CCCCGTCGCGGCCGAGGTAGGGGGAGTCTCACCGAGCCAGCT<br>AAAGGCCGTGGTGGACCCTCGAAAGCGGGAACTTCTCACCCG<br>CGAATTCGCCCATCACGGCGTTACCGGCAATAAGTCGCTCCCG<br>CCGGCCGCGCTGGAACGCCTGCCGTTCACCAGCGTCCGGCTGC<br>GAAAGCCGGACTGCCACCGACACCAACGTCCGACAGATCCCAT<br>CCGGCCACCGCTTTAAGTTGAGTAATTCCGGCGGCACGCGCGT<br>CAACGAGGCGGCCGTCGTCTACCGCACAACGGCCGGCAAGGT<br>GGCTTCCTATGTCGTGAAGAACCGCTTGGCCTTTGGGCAGACG<br>CCCCTTCCTGGAGATTTCGAGAGGGAACTTTGGCGTGCAAAAC<br>CGGGCGACGTATTGTACGATGCTGGCGGAAACCCCTTCGGAAG<br>CGTTACGAAGATCGGCAGCAACGGAACCATGACCTTGGATAC<br>AGGAAAATCAAGAATGGCACATCGGTGCCGGAAGGGAGGAAC<br>ATAG (SEQ ID NO: 57) | | | |
| | DR | CGCGAGGCCTCCCACGCACGGGTTGAAGC (SEQ ID NO: 58) | 8996 | 9024 | 29 |
| | DR | ATCTTGGCCTCGCACGCACGGGACGAAGG (SEQ ID NO: 59) | 9057 | 9085 | 29 |
| | DR | ATTTTGGCCTCGCACGCACGGGATGAAGG (SEQ ID NO: 60) | 9117 | 9145 | 29 |
| | DR | ATTTTGGCCTCGCACGCACGGGATGAAGG (SEQ ID NO: 60) | 9178 | 9206 | 29 |
| | DR | ATTTTGGCCTCGCACGCACGGGATGAAGG (SEQ ID NO: 60) | 9239 | 9267 | 29 |
| | DR | ATTTTGGCCTCGCAGGCACGGGATGAAGG (SEQ ID NO: 61) | 9300 | 9328 | 29 |
| | DR | ATTTTGGCCTCGCAGGCACGGGATGAAGG (SEQ ID NO: 61) | 9361 | 9389 | 29 |
| | DR | ATTTTGGCCTTGCAGGCACGGGATGAAGT (SEQ ID NO: 62) | 9423 | 9451 | 29 |
| | DR | ATTTTGGCCTCGCAGGCACGGGATGAAGG (SEQ ID NO: 61) | 9485 | 9513 | 29 |
| | DR | ATTTTGGCCTCGCAGGCACGGGATGAAGG (SEQ ID NO: 61) | 9545 | 9573 | 29 |
| 0315289_<br>10046034 | IntCas9 | ATGGAAAACGTGCTGGGGATAGATCTGGGCGGGAAGTTCGTC<br>GGGCTGGCAGTCGTCAGGCAGCCGGATAATCACGTCCTATGGT<br>GCGGTACCCTGCACCTGTCTGACAAGATCAAGGACCTCTACGA<br>CCTCCGCCGTGTCCTCCGCAGGGCCAGACGCTCCAGGGTCCGC<br>TATCGCAAGCCAAAGGTGCCCCAGCGTGGAGGCGGCGCCTCA<br>GGCAGCGGGGCGGACGGAGCTACCTATTTCTACCGTCGGGCCA<br>AGGGGCTCAACCAGTCCCTACGGACCAAGTGCAAGCACGTAG<br>ACCCACAGACCGGGGAAGTCTGCGGCAAGAACACCCCCGTG<br>CCGCCAATGTCCGGCATTTGCTGCTGGAGGACATCCTGGGCTT<br>CGAGCCTTTCAAGGCCGTCCCCGAATCCTACCGCCAGGCCCTG<br>CTGGAAGTGTTGGCGGCAACACAAGGCACGCCCCGAAAGCAG<br>CAGCGGCTTAAGAACATCCTTGCCCAGGTGGACGTGGACAGCT<br>ATCTCAAGAAGCAGGTGATCGACATCATCTGCAACGACCTCGA<br>TGGCCGCTGCGAGTTCTGCCGGGACCACCTGCTGGCCCACCAC<br>CAGCAGACCGCCGTCCCGAGGCAGGCGTACTGGCTGCCCCCAT<br>CGATCAAGCTCAAACAGGACTTCCTGCTCAAGCATGTCCGCCA<br>GCTTGCCCGCCGCTTCGACATCGACAGGATCGTCATCGAGCGA<br>GCCAGGTTCGACCTTCCAGAAGATTGCCGCCGGGGTTATTGACG<br>ATCCAACGGAGTACCAGCAGGGCTTCCGCTTCGAGTTCCGCAA<br>CACCCGCGCCGCACTCCTACAGGAGTACGACGGGCGGTGCTGC<br>TACTGCGGCAAGGAAGTTTTCGGTCAGAAGTGGCACGTTGACC<br>ACGTGCAGCCCCGCCGACAGGAGCAAGTCGATCGCTGGGACA<br>ACCTGGCTATCGCTTGCGAGAAGTGTAACCATCTCAAGGGCGG<br>GCGCGATCCAGAAGAAGCCGGGATGTCCTTTGCCGTGGTGACT<br>GTCAAGGCAGCCGGCAGGCCCATCAAGCGGTCATTAGCCCCC<br>AGGCCCATCGAGGGCAGCCGCATCCACAAGTACATGACCCAG<br>ACCGATCAGGGCATCCGGATGCTGAAGAGCGCCCTGGGGGAG<br>CTT (SEQ ID NO: 63) | 4343 | 5497 | 1155 |
| 0315294_<br>10042545 | IntCas9 | GTGGTCGTGAGGCCACAAGGCAAGCTGGACCATATTCCTATCC<br>CTAAACCTGAGCGAGGAGGCATTACAATTCGGTCCGAGAACG<br>TGCTGGGAATTGACTTCGGGCCGGAGCACGTGGGGCTGGCCTT<br>GGTGCGGCGGGAGCCGGCCGGGGAGCAGGTGCTCTACGCGGC<br>TTCCATCACCTTGCGCGACCTGTCCCCGGTGATGAAGGAGCGC<br>CGCGCTCTCAGGCGGCAGCGGCGCTCTGAGTCATGGTACCGCC<br>AGCCCAGGGTCCCACAGCGGGGCGGGGCAGCGCGCGGGGAG<br>CCGGGGCCCAGGAAGATGAGCAGGCCGTCGAGGGTGTGCCGG<br>AAGAGGAGGAGGATCGAAGTCGTGCGCGGTCCGCTCCCGAGT<br>ACCGGCGGGCGCAGGGATGCAATAAGCCCAAGCGAAAGTGCA<br>AGTATGTTGACCCTAAGACCGGCGAGGTCTGCGGGGCCAACA<br>CCCCTCGCAAGGAGAAGGTTCGCGATCTGCTGCTGTGGGACAT<br>CTGCCAGCACCTGCCGGTGGAACCCGAGCAGCGCCTTGCCATC<br>CTCAGCTACGTCAATCAGGTCAATATTGTCCGCCCGGAAGTGC<br>TGGCGTGCCTTGCCCTGGAAGAGCGGGCCTTGCTGGAAAACCA | 743 | 3052 | 2310 |

TABLE 13-continued

Polynucleotide Sequences Corresponding to Exemplary Type II-D IntCas9, DR, and TracrRNA

| Sequence Name | Name | Sequence | Minimum | Maximum | Length |
|---|---|---|---|---|---|
| | | TCGAGCTCTGGCCCGCGCTTCGAAGAGCAAGCCTCTCCCCCAG<br>CTTCTCTGCGAACTGAAGATCAAGAAACAGTTACAATCCCAGA<br>TTCTGGCGATCGCCAGCGGAGACCCCGAACGCAAAGCCGCCG<br>ACCTCAAGGGGCGGATGCCCTTCTGCCGCAAGCATTTTCTCCT<br>TCACCACGAACAGACCAGGATTCCCAAGCCCTCCGCCTGGCTT<br>CCGCCCAGTATCCGGTGTCGGCACGCCGACCTGGAGAGGGTCT<br>GCCGGGAGGAGGTCGCCCCCCGCTGGCCGGTCCACCGGATCA<br>GGCTGGAGCGGGCGCAGTTCGACCTGCAGGCCATTCAGCGAG<br>ATCCCCAGGGGGGGTAAGGACTGGGACCCCGAGGAGTGGC<br>AGCGAGGTCCTTGTTGGGGCCGGCGTAATATCTACTCGGCGAA<br>GCGGCATGAGCAGGGTAATCGCTGCGCCTATTGCGGAAAAAA<br>CCCCAAGAAAGAGAACCGATTAGAGCTCGAGCACGTTAAACC<br>GGGTGGCGGCAATACTTGGGATAACCTGGTGCTGGCCTGCCGT<br>AAGTGCAACCAACGCAAAGGGAAGGCTGACGCCCCGGGTGCC<br>GGTCTTGAGTTTTCCGTTGACCCCGATACCGGAGTGAGTCTGG<br>CTCCCAGGGGATTGGGAGAGTCCGTGGTGGCCCGGTACATGAC<br>CCAGACCGACCAGGGATACCGGGAGCTGGTGGCCCGCCTGCA<br>GCAATTGTTCCCCGACGCCCAGATCGAGTACCGCTACGGCTAT<br>CAGACGGATCATATTCGTAAACGGTGGATCGGCTCGGCCCAGT<br>TTGCGGAGACCGCTTTGTCACTCGGCTACAAACAGTCGCCGCC<br>GCGGCCGAAGAAACGCCGAAAGCAGTGGACCGAATTGGCGCA<br>TCTGAAGCGCAAACCCAGGCGACACAGCGATCCCCTCAAAAG<br>TCATGTGATGGACGCGGTCGCCATCGCTAGTGCCCTAGAGCTC<br>GACTCTCCGCCGCAGCTTTGCCCGGCGGAGAAGATTATCCTTC<br>GCCCTTCTCGACGCCAGCTCTTCGACACCAACCCCCTCCAGCG<br>CGGAAGTGACGACAAGTTTTACCAGCGGGTGAAGATTTGCGG<br>CACCCAGGGCGGGCTGGCCTTCGACAAGCTGAAGCACGTGGTT<br>GATGACAGCAAGCGGGCGATTCTGGAGCGAGTGCGCGACCGG<br>CTGATCGAGCAGGCTAAGGTGATCGAGCAGCCTAAGGGCAAC<br>AAAGAATCCCGCCCAGCGCCTTCACCCCGGATGCTGCCCAGC<br>TGATCCCCTTCACGTCTGTTCGCTTGGCCAAACGAGACGCCTC<br>CAAGACCAACACCCGGAGGTTAAAGGGCGGGCACTGGTACAA<br>GGTTGCCGGTGGGCCCAATTGGGCCACCGTCGTCTATCGGCTT<br>GGCGTCCGTGAACAGGTAATCGTGATTCGCAACCCAGCAGTGT<br>TCCCCGACGATTCAGCGGAACTGCCGAAAGGCGCTCAGGTGCT<br>CTTTTCCTTCCGAAAGGGAGAGTTGGTTTCCTTTGAGCAGGAT<br>GGGCAAACAACGCGCGCCCGAATCACCAAGAACAACAGCAAC<br>GGCACTCTAACCGTCGAACGCCTCGACGACGGCCGGGAAGTG<br>ACCCGGTCAGCTCGCTGCTTTCGCCCCGTCCCCCTGCTAGCGCC<br>CAACGCCTGA (SEQ ID NO: 64) | | | |
| | Tracr | CGGAGAGTGAAAAAAGCTCAGCCAAGGGAGACCCCGCGGGAA<br>ACCGTCAGGGGCCACCGTTAGGAGGCAAGTTTGGGGAATAGG<br>TAGGGGTAACCCTAAGTGCAACCTGGGGTGCGCCTTCAGCTCC<br>AGGCTCTGCAGGGTCCGGCCCAGAGGACTAACGCCCCTAACG<br>(SEQ ID NO: 65) | 553 | 720 | 168 |
| | DR | CTCCTACTCTCCGGTAAAAGGGCGGTGTGCTACAGC (SEQ ID NO: 66) | 57 | 92 | 36 |
| | DR | GTTTCACTCTCCGGTAAAAGGGCGGTGTGCTACAGC (SEQ ID NO: 67) | 123 | 158 | 36 |
| | DR | GTTTCACTCTCCGGTAAAAGGGCGGTGTGCTACAGC (SEQ ID NO: 67) | 189 | 224 | 36 |
| | DR | GTTTCACTCTCCGGTAAAAGGGCGGTGTGCTACAGC (SEQ ID NO: 67) | 255 | 290 | 36 |
| | DR | GTTTCACTCTCCGGTAAAAGGGCGGTGTGCTACAGC (SEQ ID NO: 67) | 320 | 355 | 36 |
| | DR | GTTTCACTCTCCGGTAAAAGGGCGGTGTGCTACAGC (SEQ ID NO: 67) | 385 | 420 | 36 |
| | DR | GTTTCACTCTCCGGTAAAAGGGCGGTGTGCTACAGC (SEQ ID NO: 67) | 451 | 486 | 36 |
| 0315296_<br>10011343 | IntCas9 | GTGGTCGTGAGGCCACAAGGCAAGCTGGACCATATTCCTATCC<br>CTAAACCTGAGCGAGGAGGCATTACAATTCGGTCCGAGAACG<br>TGCTGGGGATTGACTTCGGGCCGGAGCACGTGGGGCTGGCCTT<br>GGTGCGGCGGGAGCCGGCCGGGGAGCAGGTGCTCTACGCGGC<br>TTCCATCACCTTGCGCGACCTGTCCCCGGTGATGAAGGAGCGC<br>CGCGCTCTCAGGCGGCAGCGGCGCTCTGAGTCATGGTACCGCC<br>AGCCCAGGGTCCCGCAGCGGGCGGGGGCAGCGCGCGGGGAG<br>CCGGGGCCCAGGAAGATGAGCAGGCCGTCGAGGGTGTGCCGG<br>AAGAGGAGGAGGAGGATCGAAGTCGTGCGCGGTCCGCTCCCG<br>AGTACCGGCGGGCGCAGGGATGCAATAAGCCCAAGCGAAAGT<br>GCAAGTATGTTGACCCCAAGACCGGCGAGGTCTGCGGGGCCA<br>ACACCCCTCGCAAGGAGAAGGTGCGAGACCTGCTGCTGTGGG<br>ACATCTGCCAGCACTTGCGGTGGAACCTGAGCAGCGCCTTGC<br>CATCCTCAGCTACGTCAATCAGGTCAATATTGTCCGCCCGGAA | 3976 | 6303 | 2328 |

TABLE 13-continued

Polynucleotide Sequences Corresponding to Exemplary Type II-D IntCas9, DR, and TracrRNA

| Sequence Name | Name | Sequence | Minimum | Maximum | Length |
|---|---|---|---|---|---|
| | | GTGCTGGCGTGCCTTGCCCTGGAAGAGCGGGCCTTGCTGGAAA<br>ACCATCGAGCTCTGGCCCGCGCTTCGAAGAGCAAGCCTCTCCC<br>CCAGCTTCTCTGCGAACTGAAGATCAAGAAACAGTTACAATCC<br>CAGATTCTGGCGATCGCCAGCGGAGACCCCGAACGCAAAGCC<br>GCCGACCTCAAGGGGCGGATGGCCTTCTGCCGCAAGCATTTTC<br>TCCTTCACCACCAACAGACCAGGATTCCCAAGCCCTCCGCCTG<br>GCTTCCGCCCAGTATCCGGTGTCGGCACGCCGACCTGGAGAGG<br>GTCTGCCGGGAGGAGGTCGCCCCCCGCTGGCCGGTCCACCGGA<br>TCAGGCTGGAGCGGGCGCAGTTCGACCTGCAGGCCATTCAGCG<br>AGATCCCCAGGGGCGGGGTAAGGACTGGGACCCCGAGGAGTG<br>GCAGCGAGGTCCTTGTTGGGGCCGGCGCAATATCTACTCGGCG<br>AAGCGGCATGAACAGGGTAACCGCTGCGCCTATTGCGGAAAA<br>GAACCCAAGAAAGAGAACCGATTAGAGCTCGAGCACGTTAAA<br>CCGGGTGGCGGCAATACTTGGGATAACCTGGTGCTGGCCTGCC<br>GTAAGTGCAACCAACGCAAGGGGAAGGCTGAGGCCCGGGGTG<br>CCGGTCTTAAGTTCTCTGTTGACCCCGATACAGGAGTGAGTCT<br>GGCTCCCAGGGGATTGGGAGAGTCCGTGGTGGCCCGGTACAT<br>GACCCAGACCGACCAGGGATACCGGGAGCTGGTGGCTCGCCT<br>GCAGCAATTGTTCCCCGACGCCCAGATCGAGTACCGCTACGGC<br>TATCAGACGGATCATATTCGTAAACGGTGGATCGGCTCGGCCC<br>AGTTTGCGGAGACCGCTTTGTCACTCGGCTACAAACAGTCGCC<br>GCCGCGGCCAAGAAACGCCGAAAGCAGTGGAGCGAATTGGC<br>GCATCTGAAGCGCAAACCCAGGCGACACAGCGATCCCCTCAA<br>AAGTCATGTGATGGACGCGGTCGCGATAGCCGGTTCTCTCCAG<br>CGGGATTCTCCGCCGGAGCTTTGCCAGGCCGATAAGATAACCA<br>TCCGCCCTTCCCGGCGTCAACTTTTCGACACCAACCCCCTGGG<br>GCGCGGGAGCGACGGCAGGTTCTACCAGCGTGTTAAGATTTGC<br>GGGACCCAGGGAGGCCTCTCGTTTCGCAGAGTTAAACACGTGG<br>TTGACGCTCGCAAGCGGGCTATTTTGGAGCGCGTCCGTGACCT<br>GCTGATCGAGCAGGCTAAGGGCAACGAGGAATCCCCGCCCAG<br>CGCCTTCACCCCGGATGCTGCCCAGCTGATCCCCTTCACCTCTG<br>TTCGCTTGGCCAAACGAGACGCCTCCAAGACCAACACCCGGA<br>GGTTACACGCGCCAGACGATGATCGTCTGCCCCAGCAGAAGG<br>GCGGGCACTGGTACAAGGCTGCCGGTGGGCCCAATTGGGCCA<br>CCGTGGTCTATCGGCTTGGCGGCCGTGAACAGGTGGCAGTACT<br>GCGCAACCCGGCGGCTTTTCCAGACGCTTCTTCGGACATCCCG<br>GCAGGCGCTCAGGTGCTCTTTTCCTTCCGAAAGGGAAAGTTGG<br>TTTCCTTTGAGCAGGATGGGCAAACAACGCGCGCCCGAATCAC<br>CAAGAACAACAGCGACGGCACTCTAACCGTCGAACGCCTCGA<br>CGACGGCCGGGAAGTGACCCGGTCAGCTCGCTGCTTTCGCCCC<br>GTCCCCCTGCTAGCGCCCAACGCCTGA (SEQ ID NO: 68) | | | |
| | Tracr | GGAGAGTGAAAAAAGCTCAGCCAAGGGAGACCCCGCGGGAA<br>ACCGCCAGGGGCTACCGTCAGGAGGCAAGTTTGGGGAATAGG<br>TAGGGGTAACCCTAAGTGCAACCTGGGGTGCGCCTTCAGCTCC<br>AGGCTCTGCAGGGTCCGGCCCAGAGGACTAACGCCCTAACG<br>(SEQ ID NO: 69) | 3789 | 3955 | 167 |
| | DR | GTTTCACTCTCCGGTAAAAGGGCGGTGTGCTACAGC (SEQ ID NO: 67) | 3222 | 3257 | 36 |
| | DR | GTTTCACTCTCCGGTAAAAGGGCGGTGTGCTACAGC (SEQ ID NO: 67) | 3288 | 3323 | 36 |
| | DR | GTTTCACTCTCCGGTAAAAGGGCGGTGTGCTACAGC (SEQ ID NO: 67) | 3355 | 3390 | 36 |
| | DR | GTTTCACTCTCCGGTAAAAGGGCGGTGTGCTACAGC (SEQ ID NO: 67) | 3421 | 3456 | 36 |
| | DR | GTTTCACTCTCCGGTAAAAGGGCGGTGTGCTACAGC (SEQ ID NO: 67) | 3487 | 3522 | 36 |
| | DR | GTTTCACTCTCCGGTAAAAGGGCGGTGTGCTACAGC (SEQ ID NO: 67) | 3553 | 3588 | 36 |
| | DR | GTTTCACTCTCCGGTAAAAGGGCGGTGTGCTACAGC (SEQ ID NO: 67) | 3619 | 3654 | 36 |
| | DR | GTTTCACTCTCCGGTAAAAGGGCGGTGTGCTACAGC (SEQ ID NO: 67) | 3685 | 3720 | 36 |
| a0315307_1000415 | IntCas9 | GTGAGTACGAGTGCAGGCGAGTGTGTGCTCGGCCTGGACTTCG<br>GGCCGAAGCACGCTGGGCTCGCGGTGGTCCTGCGGGGTCCCTC<br>GGCCGACGAAGTGGTGTTCGCCGGGGAGGTGCGTTTGCGCGCC<br>CTGAAGGCCTTACGCTCTGACCGGAAAACCCCACTCTCCGAGC<br>GGAAGACCATACTCGGCGTCCGGCGGGCCTTGCGCCGCAGTCG<br>CCGCAGCCGCAAGCGCTACCGCCAGCCGAAGATTCCCGACGC<br>CGGCGGCGGGGCCACCACAGATACCCCGGAGAACACCAGTGC<br>CGCCAGGGGCCGCCCTCCCGAGTACCGTCGCGCCACCGGCCTC<br>AACACAGGCCGAAGAGCCTGCAAGTTCACGGACCCCACCACC<br>GGCGAAGTCTGCGCCGTGAACACCCCCCGCAAGACCAACGTG<br>CGCGACCTGCTGCTCTGGAACATCTGCCGTCACCTTCCCGTGTC | 10001 | 12067 | 2067 |

TABLE 13-continued

Polynucleotide Sequences Corresponding to Exemplary Type II-D IntCas9, DR, and TracrRNA

| Sequence Name | Name | Sequence | Minimum | Maximum | Length |
|---|---|---|---|---|---|
| | | TCTTGCAGAGCGCGCCGCCTTTGTGTCCTACGTCAACCAGCGC<br>AACCTCCAACAGGGTGAAGTGCTGGACGCGCTTCCGGCAGCG<br>GACCAGGCCGCGCTTCAGGCCGTCTTTGCTCAGCAGCGCAAGC<br>CCAAGCAGGAACCCCTTGCCGCGCGAATGCGTCGCCTGGGAGT<br>TGACCGCCACCTGCGCTCACAGATCACGGACATTGTGGGCACT<br>ACCTCACGCCGGCCCCTCAGCGGCAGGCTCTCGTTCTGTCGGC<br>AGCACTTCCTCCGCCACCACGAGCAGACCCGAGTAGCCCGTCC<br>GAGCGTGTGGCTTCCTACTACCATAGAGATGAAGCACGCGGAT<br>GTCCTCCGCGTGTGCGGCCAAGAGATCGCGCCCAGGTGGCAG<br>GTGCGCCGAATCGTGCTGGAGCGCGCGGGCTTCGACCTTCAGC<br>TCCTGCGGCAGCAAGTATCCTTGGAGTGGAGAGTGGAGGACT<br>GGCAGCGAGGGCCCCGCTGGGGCTACCGGAATACCTTCGAGG<br>CGAAGAAGCAGGACCAAGGCAACCGCTGCGCCTACTGCGGGA<br>AGAAGCCGTCACGCGAGAACCGATTTGAGCTGGAGCATGTGG<br>CCCCTGGCGGCGGCGATTCCTGGGAGAACCTGGTGCTCAGTTG<br>CCGCGCCTGCAACCAGCGCAAAGGGAGTCGAAGTCCCGCCGA<br>GGCCGGAATGCTCTTCTGGGCGACACCGAAACCGGAGAGAC<br>CCTGGCCCCGCTATCTCTCGGCCTGTCACGCGTGGCCCGCTAC<br>ATGACCCAGACTGACCAGGGCTGGCGCAGGCTGGAGGCTTCG<br>CTGCGGAGGCTGTTCCCAGGTGCAGAGGTGGAGTACACTTGGG<br>GGTATCAGACTAGCTTCTACCGCAACCGCTGGGGCCTGCCCAA<br>GAAGCACTACGCTGACGCCGCGGTCATTGCCAGCTCTCACCAA<br>CTGGAGCGCAAGCTCGCGCTTCCCGAGCAGCCGAAGCGCTTCG<br>CGCCCGCGCCAGGCGGCAAGCGGCTCTTCGACACGAACCCGCT<br>CGCGCGCGAACCCGACGGCCACTTCACCCAGCGGCAGAAGCT<br>GGTGAGCGAGCAGGGAGGGCTGACGTTCGCCGAAGTCCCACG<br>CGTGGAGAACCCGCGGAAGCGGAAGCTACTCCAGGCCGCAGC<br>CGACAAGGCAATAGCCGAGGCCGCCGCCAAAGGAGAGAAGCC<br>GCCGGCGGCGTTCACTGCGGCGATGCTTGCTGCCTTCCGTTC<br>AACTCAGTCCGCCTCACCAAGCCCGACGCGCAGGAGCGCAAT<br>ACCCGACAGCTAGGGCAGCAGTGGTTCAAAGTCGCGGGGGGC<br>CCCAACGTCGCCACCATCCTCTACGAACACAACGGCAACCAGG<br>CCACCCTCGTCAAACGGAACCCCGCTATCTTCCGCGCTGACCC<br>AGGCTGCCCAGAGGGGCGCGCGTTCTTGCGGTCTACCGCAAA<br>GGTGACTTCGTGGAGTGCAGCGACGGCCTGGGCCGGGTGACG<br>AAGAACCACAGCAACGGCACTCTAACTGTCGAACTGGTGGAT<br>ACAGGAAAGGCGGTGACGCGGCAGGCCAAGTCGTTCCGGCCG<br>GCGCGCAAGCCGCCGCGAGGATAG (SEQ ID NO: 70) | | | |
| | Tracr | GAAGGGCGAAAACAGCCCAGCCAAGACTCGCCGCGGACAGGC<br>CTGGTAGCACAGGACTGAGCCGGTGTGGCGAGCGCGGGAAAC<br>CGGCGGGGAAACTCGGCCGGCTACCGTCAGGAGGCACGTTTG<br>GGGAACAGGTAGGGGCAACCCTGAGTGCAACCTGGGGTGCAC<br>CTTCAGCTCCAGGCTCTGCAAGGCTCGGCCCAGAGGGACTAAC<br>GCCCTAATC (SEQ ID NO: 71) | 9668 | 9887 | 220 |
| | DR | TTTCGCCCTCGCGCTGGTGGACACGGTG (SEQ ID NO: 72) | 9077 | 9104 | 28 |
| | DR | TTTCGCCCTCGCGCTGGTGGACACGGTG (SEQ ID NO: 72) | 9138 | 9165 | 28 |
| | DR | TTTCGCCCTCGCGCTGGTGGACACGGTG (SEQ ID NO: 72) | 9200 | 9227 | 28 |
| | DR | TTTCGCCCTCGCGCTGGTGGACACGGTG (SEQ ID NO: 72) | 9261 | 9288 | 28 |
| | DR | TTTCGCCCTCGCGCTGGTGGACACGGCG (SEQ ID NO: 73) | 9322 | 9349 | 28 |
| | DR | TTTCGCCCTCGCGCTGGTGGACACGGCT (SEQ ID NO: 74) | 9383 | 9410 | 28 |
| | DR | TTTCGCCCTCGCGCTGGTGGACACGGCG (SEQ ID NO: 73) | 9444 | 9471 | 28 |
| | DR | TTTCGCCCTCGCGCTGGTGGACACGGTG (SEQ ID NO: 72) | 9505 | 9532 | 28 |
| | DR | TTTCGCCCTCGCGCTGGTGGACAGGGCG (SEQ ID NO: 75) | 9566 | 9593 | 28 |
| a0315541_<br>1000067 | IntCas9 | ATGCCGAACGTGCTGGGGATAGATTTGGGCGGCAAAGCCGTG<br>GGGCTCGCCGTGGTGGAGCAGCCGGACAACCGCGTTGCATGG<br>TGCGGGACCGTCACCCTTTCCGACAGGATCAAGGATCTGTACG<br>ACCAGCGCCGGACGCTGCGCCGGGGCCGGCGCTCACGCGTGC<br>GTTACCGCAAGCCCAAAGTTGCCGAACGGGGTGGCGGCTCGG<br>CCGGTCAGACTCAGTGGAGCGGATTCAAATACCGCCGGGCCA<br>AGGGGCTCAACCAGTCACTCCGGACCAAGTGCAAGTACGTCG<br>ACCGGGAAACCGGCGAAGTCTGCGAACGGAACACGCCAAAGA<br>AGGCCAATGTCCGCCATCTCCTTATCCAGGACATCCTGAGCTT<br>TCAGCCGTTCGCCGAGGTGCCGCCGGATCACAGACAGGTCATC<br>CGCGATGTCCTTGCCTCGCGCGAAGGTGCAGGAACCCGGCGTA<br>AGCGGCTCCAGAACATCCTCAGCCGGCTCAACGTGGACACTTA<br>CCTCAAGAAGCAGGTCGACGACATCTGCTTCAACGATCTCCCC<br>GGCCGGGCCGAATTCTGCCGCAAACACATCCTCGCTCACCATG<br>AGCAGACGGACATACCGGCACAGGCCGTTTGGCTCCCGCCATC<br>GATCCGCCTAAAGCAGGACTTTGTCCTGAAGCAGATTCGGGTT<br>CTGTCGCGCCGATTCCGTATCGACAAGATCGTCATCGAGCGGG<br>CGAACTTCGACCTCCAGAAGATTGCGGCGGGAGTGATCGATG<br>ATCCGGCGGAATATCAGGAAGGTCACCGCTACGGCTTCCGGA<br>ACACCCGCGCGGCGATGATGCAGGAGTACGGGGCGCGGTGCT | 10001 | 11920 | 1920 |

TABLE 13-continued

Polynucleotide Sequences Corresponding to Exemplary Type II-D IntCas9, DR, and TracrRNA

| Sequence Name | Name | Sequence | Minimum | Maximum | Length |
|---|---|---|---|---|---|
| | | GCTATTGCGGCAAGAGCGTGGTAGGCAAGAAGTGGCACCTTG | | | |
| | | ACCACATCGAGCCCAAGAAGACCGGCGAGATCAACCGCTGGG | | | |
| | | ATAATCTGGCCATCGCCTGCGAAAAGTGCAATCAGCGGAAGG | | | |
| | | GCAGCAGGACACCCACGGAGGCGGGCATGTCCTTCGCCGTCGT | | | |
| | | TTCCGAAAACATCGCGGGCAGGCGGATCAGGCGCTCATTGGC | | | |
| | | GCCCAAGCCCGTGGAGGGCGGCCGCATCCACAAGTACATGAC | | | |
| | | ACAGACCGATCAAGGCATCCGCATCCTGAAGCGCAACCTGGG | | | |
| | | GGCAATCATCCCCCATGCACCCATCGAAGAAACGTTCGGCTAC | | | |
| | | GACACCGCGGCCTGGCGGGGCGTGTGGGGCCTGGAGAAAGGC | | | |
| | | AAGGAGAAGGGGGAACATCACAACGACGCAATTGTCATCGCC | | | |
| | | TCGCTGCGGTCACCGGAGGCGGGGCCGATCATCGAAGTGGAC | | | |
| | | CCGGAAGTGAGCCGCCAGGCTGTCGGCGGGAAGCGGATATTC | | | |
| | | GACCAGAACCCCATCCAGCGCGCAGGCGACGGCAACCACTAT | | | |
| | | CAGAGGATCCCGGTCGTCGCCGAGGTCGGCGGCATCACGCCG | | | |
| | | AGACAACTCCGGGCCGTGGTGGACGAACAGAAGAGGGCGCTC | | | |
| | | CTGGCACGCGAGTTCGAGCGGCTCGAGATCAAGGGGAATCGG | | | |
| | | TCGCTTCCGGATAGGGCCCGCCAGCGCTTGCCCTTCAAGAGCG | | | |
| | | TCCGCCTCCGCAAAAGAGACTGCACGGACGAGAACGTTCGCA | | | |
| | | CGATGAAAAGCGGGCACCGCTTCAAGGTCTCCAACGTCGGCG | | | |
| | | GGACGCGCGTCAACGAGGCACTGGTCGTGTACCGCACACATG | | | |
| | | CGGGGAAGGTAGCGTGCTATCCGATGAAGAACCGGCGTGCCT | | | |
| | | TCGGGCCTACACTTCCGCCAGCGGACTTTGAAAAGGAGCTTAG | | | |
| | | GCGTTTCAGGCCCGCCGACGCGGTATACGAGGCTGGGGGGAA | | | |
| | | GGAACTAGGGCGGATCGTCGTTCTCTGGAGCAGCGGTCGCGTG | | | |
| | | AAGCTGGACAGTGGGGTAACCAGGGCGGCGACCAAATGCTTG | | | |
| | | AAAGGAGGTGGTTGA (SEQ ID NO: 76) | | | |
| | Tracr | CTAGGTCAAAAGCACGCCTCAGCGATTCCCCGACTGTTCGGGG | 12378 | 12562 | 185 |
| | | AAGCCAGGGAACCCAACGAAAGGCGGGACCTGGCCAGGAGCT | | | |
| | | ACGTTTGCAGGACAGCCAAAGACCTATGCCGGGATGTAGTGCC | | | |
| | | TCGTCTACCCAGTCCCGGCCTCTTGGAGTCTCGGCCCGGAAGA | | | |
| | | TTAACGCCCTCGCC (SEQ ID NO: 77) | | | |
| | DR | GGTCGCAGCGTGCATGGGATGAAT (SEQ ID NO: 78) | 11945 | 11968 | 24 |
| | DR | TGGCCTCGCGTGCATGGGATGAAT (SEQ ID NO: 79) | 12006 | 12029 | 24 |
| | DR | TGGCCTCGCGTGCATGGGATGAAT (SEQ ID NO: 79) | 12067 | 12090 | 24 |
| | DR | TGGCCTCGCGTGCATGGGATGAAT (SEQ ID NO: 79) | 12130 | 12153 | 24 |
| | DR | TGGCCTCGCGTGCATGGGATGAAT (SEQ ID NO: 79) | 12190 | 12213 | 24 |
| | DR | TGGCCTCGCGTGCATGGGATGAAT (SEQ ID NO: 79) | 12251 | 12274 | 24 |

TABLE 14

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| 80 | 0315296_10011343_organized (Accession 0315296_10011343) | Padding | <1..6024 |
| | | CDS Annotated | 6026..7423 /product="orf(7,281647,11342,0)$zz$Partial ORF @ 1-1399" complement(6026..8092) /product="-> pfam01074(7,315)[87.0] \| pfam07748(438,689)[50.7] \| pfam09261(328,405) [33.4] \| COG0383(3,162)[110.4] \| COG0383(291,526)[24.4] : A(7,281647,11342,0)$zz$alpha-mannosidase/ mannosylglycerate hydrolase & KO:K01191,KO:K15524" |
| | | Questional_CDS | 6045..6320 /product="orf(7,281647,11342,2)$zz$Partial ORF @ 20-296" |
| | | Questional_CDS | complement(6259..6465) /product="orf(7,281647,11342,3)$zz$ORF @ 234-441" |
| | | Questional_CDS | complement(6462..7202) /product="orf(7,281647,11342,4)$zz$ORF @ 437-1178" |
| | | Questional_CDS | 7451..8110 /product="orf(7,281647,11342,5)$zz$ORF @ 1426-2086" |
| | | Questional_CDS | complement(7735..8148) /product="orf(7,281647,11342,6)$zz$ORF @ 1710-2124" |
| | | Questional_CDS | 8220..8477 /product="orf(7,281647,11342,7)$zz$ORF @ 2195-2453" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | Annotated | 8389..8916<br>/product="–> pfam01467(40,168)[58.6] \|<br>COG2870(4,173)[186.2] :<br>A(7,281647,11342,1)$zz$D-beta-D-heptose 7-phosphate kinase/D-beta-D-heptose 1-phosphate adenosyltransferase &<br>KO:K03272" |
| | | Questional_CDS | complement(8404..9108) /product="orf(7,281647,11342,9)$zz$ORF @ 2379-3084"<br>Questional_CDS 8913..9089<br>/product="orf(7,281647,11342,10)$zz$ORF @ 2888-3065" |
| | | DR | 9247..9281 |
| | | DR | 9313..9347 |
| | | DR | 9380..9414 |
| | | DR | 9446..9480 |
| | | Questional_CDS | 9488..9697 /product="orf(7,281647,11342,11)$zz$ORF @ 3463-3673" |
| | | DR | 9512..9546 |
| | | DR | 9578..9612 |
| | | DR | 9644..9678 |
| | | DR | 9710..9744 |
| | | POI | 10000..12327<br>/product="–> IscB(28,91)[44.2] \| IscB(278,568) [92.9] \|<br>pfam14279(364,412)[41.5] \| pfam14239(21,101)<br>[36.7] \|<br>COG1403(277,421)[24.1] :<br>A(7,281647,11342,2)$zz$5-methylcytosine-specific<br>restriction endonuclease McrA & COG1403" |
| | | Annotated | 10000..12327<br>/product="–> IscB(28,91)[44.2] \| IscB(278,568)<br>[92.9] \| pfam14279(364,412)[41.5] \| pfam14239(21,101) [36.7] \|<br>COG1403(277,421)[24.1] :<br>A(7,281647,11342,2)$zz$5-methylcytosine-specific<br>restriction endonuclease McrA & COG1403" |
| | | Questional_CDS | complement(10161..10553)<br>/product="orf(7,281647,11342,13)$zz$ORF @ 4136-4529" |
| | | Questional_CDS | complement(10243..10641)<br>/product="orf(7,281647,11342,14)$zz$ORF @ 4218-4617" |
| | | Questional_CDS | 10313..10699<br>/product="orf(7,281647,11342,15)$zz$ORF @, 4288-4675" |
| | | Questional_CDS | complement(10714..11073)<br>/product="orf(7,281647,11342,16)$zz$ORF @ 4689-5049" |
| | | Questional_CDS | complement(11094..11318)<br>/product="orf(7,281647,11342,17)$zz$ORF @, 5069-5294" |
| | | Questional_CDS | 11128..11418)<br>/product="orf(7,281647,11342,18)$zz$ORF @ 5103-5394" |
| | | Questional_CDS | 11978..12241<br>/product="orf(7,281647,11342,19)$zz$ORF @ 5953-6217" |
| | | CDS | complement(12138..12749)<br>/product="A(7,281647,11342,3)$zz$hypothetical<br>protein" |
| | | Questional_CDS | complement(12141..12731)<br>/product="orf(7,281647,11342,20)$zz$Partial ORF @ 6116-6707" |
| | | Questional_CDS | 12332..12748<br>/product="orf(7,281647,11342,22)$zz$Partial ORF @ 6307-6724" |
| 81 | 0272441_10020685_organized<br>(Accession<br>0272441_10020685) | Padding | <1..5667<br>/label |
| | | Questional_CDS | 5669..5995 /product="orf(4,280925,20684,0)$zz$Partial ORF @ 1-328" |
| | | Questional_CDS | complement(5669..6163)<br>/product="orf(4,280925,20684,1)$zz$Partial ORF @ 1-496" |
| | | Annotated | 5670..6428<br>/product="–> pfam02347(2,249)[238.0] \|<br>COG0403(1,253)[276.0] :<br>orf(4,280925,20684,2)$zz$Partial<br>ORF @ 2-761" |
| | | Annotated | 5670..6431<br>/product="–> pfam02347(2,249)[238.0] \|<br>COG0403(1,253)[276.0] :<br>A(4,280925,20684,0)$zz$glycine<br>dehydrogenase subunit 1 & KO:K00282" |
| | | Questional_CDS | complement(5670..6410)<br>/product="orf(4,280925,20684,3)$zz$Partial ORF @ 2-743"<br>CDS complement(6329..8542)<br>/product="orf(4,280925,20684,4)$zz$ORF @<br>661-2875" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | Annotated | 6428..7876<br>/product="-> pfam02347(17,308)[33.4] \|<br>COG1003(4,481)[610.4] :<br>A(4,280925,20684,1)$zz$glycine<br>dehydrogenase subunit 2 & KO:K00283" |
| | | CDS | 6640..8136<br>/product="orf(4,280925,20684,6)$zz$ORF @<br>972-2469" |
| | | Questional_CDS | complement(6748..7059)<br>/product="orf(4,280925,20684,7)$zz$ORF @<br>1080-1392" |
| | | Questional_CDS | complement(7660..7911)<br>/product="orf(4,280925,20684,8)$zz$ORF @<br>1992-2244" |
| | | Questional_CDS | 7737..8072)<br>/product="orf(4,280925,20684,9)$zz$ORF @<br>2069-2405" |
| | | Questional_CDS | complement(7978..8163)<br>/product="orf(4,280925,20684,10)$zz$ORF @<br>2310-2496" |
| | | CDS | 8063..9379<br>/product="A(4,280925,20684,2)$zz$hypothetical<br>protein" |
| | | Questional_CDS | 8430..8795<br>/product="orf(4,280925,20684,12)$zz$ORF @<br>2762-3128" |
| | | Questional_CDS | 8612..9799)<br>/product="orf(4,280925,20684,13)$zz$ORF @<br>2944-4132" |
| | | Questional_CDS | 8820..9194<br>/product="orf(4,280925,20684,14)$zz$ORF @<br>3152-3527" |
| | | Questional_CDS | 9855..10052)<br>/product="orf(4,280925,20684,15)$zz$ORF @<br>4187-4385" |
| | | Questional_CDS | complement(9958..11097)<br>/product="orf(4,280925,20684,16)$zz$ORF @<br>4290-5430" |
| | | POI | 10000..11937<br>/product="-> IscB(4,486)[180.3] \|<br>pfam01844(285,330)[40.5]\| pfam14239(2,72)[40.4] \|<br>pfam14239(132,265)[33.1] \|COG1403(188,350)[46.3]<br>:A(4,280925,20684,3)$zz$5-methylcytosinespecificrestriction<br>endonuclease McrA & COG1403" |
| | | Annotated | 10000..11937<br>/product="-> IscB(4,486)[180.3] \|<br>pfam01844(285,330)[40.5]\| pfam14239(2,72)[40.4] \|<br>pfam14239(132,265)[33.1] \|COG1403(188,350)[46.3]<br>:A(4,280925,20684,3)$zz$5-methylcytosinespecificrestriction<br>endonuclease McrA & COG1403" |
| | | Questional_CDS | complement(10857..11267)<br>/product="orf(4,280925,20684,18)$zz$ORF @<br>5189-5600" |
| | | Questional_CDS | 10901..11107<br>/product="orf(4,280925,20684,19)$zz$ORF @<br>5233-5440" |
| | | Questional_CDS | complement(11224..12135)<br>/product="orf(4,280925,20684,20)$zz$ORF @<br>5556-6468" |
| | | Questional_CDS | complement(11907..12320)<br>/product="orf(4,280925,20684,21)$zz$ORF @<br>6239-6653" |
| | | Questional_CDS | complement(11927..12178)<br>/product="orf(4,280925,20684,22)$zz$ORF @<br>6259-6511" |
| | | DR | 12012..12039 |
| | | DR | 12073..12100 |
| | | DR | 12134..12161 |
| | | DR | 12195..12222 |
| | | DR | 12257..12284 |
| | | DR | 12319..12346 |
| | | DR | 12380..12407 |
| | | DR | 12441..12468 |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | Questional_CDS | 12489..12938 /product="orf(4,280925,20684,23)$zz$ORF @ 6821-7271" |
| | | Questional_CDS | complement(12650..12838) /product="orf(4,280925,20684,24)$zz$ORF @ 6982-7171" |
| | | Questional_CDS | 12677..12868 /product="orf(4,280925,20684,25)$zz$ORF @ 7009-7201" |
| | | CDS | 12948..13382 /product="A(4,280925,20684,4)$zz$hypothetical protein" |
| | | Questional_CDS | complement(13010..13399) /product="orf(4,280925,20684,27)$zz$ORF @ 7342-7732" |
| | | Questional_CDS | 13277..13789 /product="orf(4,280925,20684,28)$zz$ORF @ 7609-8122" |
| | | CDS | 13387..13623 /product="A(4,280925,20684,5)$zz$hypothetical protein" |
| | | Questional_CDS | 13389..14006 /product="orf(4,280925,20684,29)$zz$ORF @ 7721-8339" |
| | | Questional_CDS | complement(13563..14405) /product="orf(4,280925,20684,30)$zz$Partial ORF @ 7895-8738" |
| | | Questional_CDS | 13705..13920 /product="orf(4,280925,20684,31)$zz$ORF @ 8037-8253" |
| | | CDS | complement(13898..14404) /product="A(4,280925,20684,6)$zz$hypothetical protein" |
| | | Questional_CDS | complement(13901..14404) /product="orf(4,280925,20684,32)$zz$Partial ORF @ 8233-8737" |
| 82 | 0209343_10010378_organized (Accession 0209343_10010378) | Padding | <1..5585 /label |
| | | Annotated | 5586..5999 /product="-> pfam01927(1,134)[113.5] \| COG1656(1,138)[106.6] : orf(18,34854,10377,0)$zz$Partial ORF @ 0-414" |
| | | Annotated | 5586..6002 /product="-> pfam01927(1,134)[113.5] \| COG1656(1,138)[106.6] : A(18,34854,10377,0)$zz$hypothetical protein" |
| | | Questional_CDS | 5869..6084 /product="orf(18,34854,10377,1)$zz$ORF @ 283-499" |
| | | CDS | complement(6007..6675) /product="A(18,34854,10377,1)$zz$hypothetical protein" |
| | | CDS | complement(6742..7347) /product="A(18,34854,10377,2)$zz$hypothetical protein" |
| | | CDS | complement(7357..7695) /product="A(18,34854,10377,3)$zz$hypothetical protein" |
| | | Questional_CDS | 7526..7708 /product="orf(18,34854,10377,5)$zz$ORF @ 1940-2123" |
| | | Annotated | 7892..8260 /product="-> pfam14489(45,122)[107.9] \| COG0780(1,122)[141.0] : A(18,34854,10377,4)$zz$7-cyano-7-deazaguanine reductase & KO:K09457" |
| | | Annotated | complement(8329..8664) /product="-> pfam00512(30,94)[39.5] \| COG0642(1,110)[25.1]: A(18,34854,10377,5)$zz$signal transduction histidinekinase & COG0642" |
| | | Annotated | complement(8869..9876) /product="-> pfam00933(5,328)[311.9] \| COG1472(4,334)[299.0] : A(18,34854,10377,6)$zz$beta-Nacetylhexosaminidase & KO:K01207" |
| | | Questional_CDS | 9392..9595 /product="orf(18,34854,10377,9)$zz$ORF @ 3806-4010" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | POI | 10000..11976 /product="–> IscB(1,637)[196.2] \| pfam14239(1,74) [51.5] \| pfam14279(256,312)[35.7] \| pfam14239(175,236) [28.3] \| COG1403(221,320)[36.1] : A(18,34854,10377,7)$zz$5-methylcytosine-specific restriction endonuclease McrA & COG1403" |
| | | Annotated | 10000..11976 /product="–> IscB(1,637)[196.2] \| pfam14239(1,74) [51.5] \| pfam14279(256,312)[35.7] \| pfam14239(175,236) [28.3] \| COG1403(221,320)[36.1] : A(18,34854,10377,7)$zz$5-methylcytosine-specific restriction endonuclease McrA & COG1403" |
| | | Questional_CDS | complement(10086..10451) /product="orf(18,34854,10377,11)$zz$ORF @ 4500-4866" |
| | | Questional_CDS | complement(10552..10818) /product="orf(18,34854,10377,12)$zz$ORF @ 4966-5233" |
| | | Questional_CDS | complement(10821..11102) /product="orf(18,34854,10377,13)$zz$ORF @ 5235-5517" |
| | | Questional_CDS | complement(12050..12229) /product="orf(18,34854,10377,14)$zz$ORF @ 6464-6644" |
| | | DR | 12281..12308 |
| | | DR | 12346..12373 |
| | | Questional_CDS | complement(12478..12723) /product="orf(18,34854,10377,15)$zz$ORF @ 6892-7138" |
| | | CDS | 12502..12825 /product="A(18,34854,10377,8)$zz$hypothetical protein" |
| | | CDS | 12822..13163 /product="A(18,34854,10377,9)$zz$hypothetical protein" |
| | | Questional_CDS | 13070..13291) /product="orf(18,34854,10377,18)$zz$ORF @ 7484-7706" |
| | | Annotated | 13160..13759 /product="–> pfam02441(14,187)[96.0] \| COG0163(12,198)[232.5] : A(18,34854,10377,10)$zz$4-hydroxy-3-polyprenylbenzoate decarboxylase & KO:K03186" |
| | | Questional_CDS | 13725..13922 /product="orf(18,34854,10377,20)$zz$ORF @ 8139-8337" |
| | | Annotated | complement(13767..15710) /product="–> pfam09334(147,359)[206.8] \| pfam09334(4,151)[157.5] \| pfam01588(553,645) [94.8] \| pfam08264(398,572)[29.4] \| COG0143(1,528)[569.8] \| COG0073(532,647)[109.5] : A(18,34854,10377,11)$zz$methionyl-tRNA synthetase & KO:K01874" |
| | | Questional_CDS | complement(14837..15055) /product="orf(18,34854,10377,22)$zz$ORF @ 9251-9470" |
| | | Questional_CDS | 15504..15770 /product="orf(18,34854,10377,23)$zz$ORF @ 9918-10185" |
| | | Annotated | complement(15834..16187) /product="–> pfam13277(1,113)[181.2] \| COG1692(1,117)[174.5] : A(18,34854,10377,12)$zz$hypothetical protein" |
| | | Annotated | complement(15837..16166) /product="–> pfam13277(1,113)[181.2] \| COG1692(1,117)[174.5] : orf(18,34854,10377,24)$zz$Partial ORF @ 10251-10581" |
| 83 | 0315289_10046034_organized (Accession 0315289_10046034) | Padding | <1..5657 /label |
| | | CDS | complement(5660..5800) /product="A(7,281640,46033,3)$zz$PEP-CTERM motif-containing protein & pfam07589" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | Annotated | complement(5932..6750) /product="-> pfam07963(1,26)[25.6] \| COG2165(1,40)[34.8] :A(7,281640,46033,2)$zz$type II secretory pathwaypseudopilin PulG & COG2165" |
| | | Questional_CDS | 6067..7056 /product="orf(7,281640,46033,19)$zz$ORF @ 4099-5089" |
| | | Questional_CDS | complement(6101..6298) /product="orf(7,281640,46033,22)$zz$ORF @ 4857-5055" |
| | | Questional_CDS | 6590..6991 /product="orf(7,281640,46033,20)$zz$ORF @ 4164-4566" |
| | | Annotated | complement(7154..9592) /product="-> pfam12804(9,233)[63.3] \| pfam10509(331,381)[48.7] \| pfam00288(459,525) [36.2] \| pfam08544(711,790)[28.0] \| COG0153(322,697) [146.5] \| COG1207(5,295)[125.8] \| COG0153(710,811)[38.9] : A(7,281640,46033,1)$zz$N-acetylgalactosamine kinase & KO:K18674" |
| | | Questional_CDS | 7290..7637 /product="orf(7,281640,46033,18)$zz$ORF @ 3518-3866" |
| | | Questional_CDS | complement(7330..7761) /product="orf(7,281640,46033,17)$zz$ORF @ 3394-3826" |
| | | Questional_CDS | 7975 /product="orf(7,281640,46033,16)$zz$ORF @ 3180-3510" |
| | | Questional_CDS | complement(7857..8072) /product="orf(7,281640,46033,15)$zz$ORF (a 3083-3299" |
| | | Questional_CDS | 8028..8255 /product="orf(7,281640,46033,14)$zz$ORF @ 2900-3128" |
| | | Questional_CDS | 8923 /product="orf(7,281640,46033,13)$zz$ORF @ 2232-2874" |
| | | CDS | complement(8361..9569) /product="orf(7,281640,46033,11)$zz$ORF @ 1586-2795" |
| | | Questional_CDS | 9093..9290 /product="orf(7,281640,46033,12)$zz$ORF @ 1865-2063" |
| | | Questional_CDS | 9468..9698 /product="orf(7,281640,46033,9)$zz$ORF @ 1457-1688"' |
| | | Questional_CDS | complement(9619..9846) /product="orf(7,281640,46033,8)$zz$ORF @ 1309-1537" |
| | | Questional_CDS | 9652..9969 /product="orf(7,281640,46033,7)$zz$ORF @ 1186-1504" |
| | | Questional_CDS | 9695..9976 /product="orf(7,281640,46033,6)$zz$ORF @ 1179-1461" |
| | | POI | 10000..11154 /product="-> IscB(4,65)[51.3] \| IscB(205,334) [115.8] \| pfam01844(284,329)[38.9] \| pfam14239(2,72)[37.7] \| pfam14239(198,264)[36.1] \| COG1403(255,351) [48.7] : A(7,281640,46033,0)$zz$5-methylcytosine-specific restriction endonuclease McrA & COG1403" |
| | | Annotated | 10000..11154 /product="-> IscB(4,65)[51.3] \| IscB(205,334) [115.8] \| pfam01844(284,329)[38.9] \| pfam14239(2,72)[37.7] \| pfam14239(198,264)[36.1] \| COG1403(255,351) [48.7] : A(7,281640,46033,0)$zz$5-methylcytosine-specific restriction endonuclease McrA & COG1403" |
| | | Questional_CDS | complement(10273..10674) /product="orf(7,281640,46033,4)$zz$ORF @ 481-883" |
| | | Questional_CDS | 10346..10528 /product="orf(7,281640,46033,5)$zz$ORF @ 627-810" |
| | | Questional_CDS | complement(10509..10718) /product="orf(7,281640,46033,3)$zz$ORF @ 437-647" |
| | | Questional_CDS | 10553..11023 /product="orf(7,281640,46033,2)$zz$ORF @ 132-603" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | Questional_CDS | complement(10878..11102)<br>/product="orf(7,281640,46033,1)$zz$ORF @ 53-278" |
| 84 | 0265297__10050537__organized (Accession 0265297__10050537) | Padding | <1..9999<br>/label |
| | | POI | POI 10000..11835<br>/product="-> IscB(174,603)[92.2] \| cas9(246,295)[35.4] \|<br>pfam14279(249,304)[63.2] \| COG1403(222,306)[52.3] :<br>orf(3,280701,50536,11)$zz$Partial ORF @ 1843-3679" |
| | | Questional_CDS | 10001..10183<br>/product="orf(3,280701,50536,13)$zz$Partial ORF @ 3495-3678" |
| | | Questional_CDS | 10164..10418)<br>/product="orf(3,280701,50536,12)$zz$ORF @ 3260-3515" |
| | | CDS | complement(11852..13336)<br>/product="orf(3,280701,50536,2)$zz$ORF @ 342-1827" |
| | | Questional_CDS | 11907..12137<br>/product="orf(3,280701,50536,10)$zz$ORF @ 1541-1772" |
| | | Questional_CDS | 12260..12553<br>/product="orf(3,280701,50536,6)$zz$ORF @ 1125-1419" |
| | | Questional_CDS | 12268..12447<br>/product="orf(3,280701,50536,9)$zz$ORF @ 1231-1411" |
| | | Questional_CDS | 12512<br>/product="orf(3,280701,50536,8)$zz$ORF @ 1166-1397" |
| | | Questional_CDS | complement(12319..12519)<br>/product="orf(3,280701,50536,7)$zz$ORF @ 1159-1360" |
| | | Questional_CDS | complement(12444..12767)<br>/product="orf(3,280701,50536,5)$zz$ORF @ 911-1235" |
| | | Questional_CDS | 12738..12926<br>/product="orf(3,280701,50536,4)$zz$ORF @ 752-941" |
| | | Questional_CDS | 13059..13259<br>/product="orf(3,280701,50536,3)$zz$ORF @ 419-620" |
| | | Annotated | complement(13333..13677)<br>/product="-> pfam02369(7,104)[35.5] :<br>A(3,280701,50536,0)$zz$Ig-like protein group 1 & pfam02369" |
| | | Annotated | complement(13336..13653)<br>/product="-> pfam02369(7,104)[35.5] :<br>orf(3,280701,50536,1)$zz$Partial ORF @ 25-343" |
| | | Questional_CDS | complement(13367..13678)<br>/product="orf(3,280701,50536,0)$zz$Partial ORF @ 0-312" |
| 85 | 0315281__10072405__organized (Accession 0315281__10072405) | Padding | <1..9998<br>/label |
| | | POI | 10000..11496<br>/product="-> IscB(18,374)[119.9] \|<br>pfam14279(95,151)[32.1]\| COG1403(80,157)[36.2]<br>:A(7,281632,72404,0)$zz$5-methylcytosine specific restriction endonuclease McrA & COG1403" |
| | | Annotated | 10000..11496<br>/product="-> IscB(18,374)[119.9] \|<br>pfam14279(95,151)[32.1]\| COG1403(80,157)[36.2]<br>:A(7,281632,72404,0)$zz$5-methylcytosine specific restriction endonuclease McrA & COG1403" |
| | | Annotated | 10024..11493<br>/product="-> IscB(10,366)[120.1] \|<br>pfam14279(95,151)[32.1]\| COG1403(80,157)[36.2] :<br>orf(7,281632,72404,0)$zz$PartialORF @ 25-1495" |
| | | Questional_CDS | complement(10135..10335)<br>/product="orf(7,281632,72404,1)$zz$ORF @ 136-337" |
| | | Questional_CDS | complement(10338..10556)<br>/product="orf(7,281632,72404,2)$zz$ORF @ 339-558" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | Questional_CDS | /product="orf(7,281632,72404,3)$zz$ORF @ 1179-1371" |
| | | DR | 11723..11751 |
| | | DR | 11789..11817 |
| | | DR | 11854..11882 |
| | | DR | 11921..11949 |
| | | DR | 11989..12017 |
| | | DR | 12056..12084 |
| | | Annotated | 12973..13314 /product="–> pfam04430(3,110)[90.1] \| COG1504(1,113)[110.9] : A(7,281632,72404,1)$zz$hypothetical protein" |
| | | Questional_CDS | complement(13044..13217) /product="orf(7,281632,72404,5)$zz$ORF @ 3045-3219" |
| | | Annotated | complement(13255..13614) /product="–> pfam04493(18,112)[66.1] \| COG1515(5,102)[73.6] : A(7,281632,72404,2)$zz$deoxyribonuclease V & KO:K05982" |
| | | Annotated | 13796..14077 /product="–> pfam01817(8,85)[84.8] \| COG1605(1,93)[82.7] :A(7,281632,72404,3)$zz$chorismate mutase/prephenatedehydratase & KO:K14170" |
| 86 | a0315541_1000067_organized (Definition Ga0315541_1000067) | Questional_CDS | complement(415..636) /product="orf(4,280937,66,103)$zz$ORF @ 29595-29817" /label="orf(4,280937,66,103)$zz$ORF @ 29595-29817 CDS" |
| | | CDS | 581..2095 /product="orf(4,280937,66,99)$zz$ORF @ 28136-29651" /label="orf(4,280937,66,99)$zz$ORF @ 28136-29651 CDS" |
| | | CDS | complement(633..2156) /product="orf(4,280937,66,98)$zz$ORF @ 28075-29599" /label="orf(4,280937,66,98)$zz$ORF @ 28075-29599 CDS" |
| | | Questional_CDS | 726..1109 /product="orf(4,280937,66,102)$zz$ORF @ 29122-29506" /label="orf(4,280937,66,102)$zz$ORF @ 29122-29506 CDS" |
| | | Questional_CDS | 1299..1490 /product="orf(4,280937,66,101)$zz$ORF @ 28741-28933" /label="orf(4,280937,66,101)$zz$ORF @ 28741-28933 CDS" |
| | | Annotated | complement(2089..3216) /product="–> pfam01882(48,133)[73.1] \| pfam13519(91,196)[27.5] \| COG1721(13,299) [126.3] : orf(4,280937,66,94)$zz$ORF @ 27015-28143" /label="–> pfam01882(48,133)[73.1] \| pfam13519(91,196)[27.5] \| COG1721(13,299) [126.3] : orf(4,280937,66,94)$zz$ORF @ 27015-28143 CDS" |
| | | Questional_CDS | 2248..3003 /product="orf(4,280937,66,96)$zz$ORF @ 27228-27984" /label="orf(4,280937,66,96)$zz$ORF @ 27228-27984 CDS" |
| | | Questional_CDS | 2339..2656 /product="orf(4,280937,66,97)$zz$ORF @ 27575-27893" /label="orf(4,280937,66,97)$zz$ORF @ 27575-27893 CDS" |
| | | Questional_CDS | complement(2676..3017) /product="orf(4,280937,66,95)$zz$ORF @ 27214-27556" /label="orf(4,280937,66,95)$zz$ORF @ 27214-27556 CDS" |
| | | Annotated | complement(3050..4090) /product="–> pfam07726(58,192)[207.6] \| COG0714(14,343)[279.1] : A(4,280937,66,17)$zz$MoxR-like ATPase & KO:K03924" /label="–> pfam07726(58,192)[207.6] \| COG0714(14,343)[279.1] : A(4,280937,66,17)$zz$MoxR-like ATPase & KO:K03924 CDS" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | Questional_CDS | 3651..4085<br>/product="orf(4,280937,66,93)$zz$ORF @ 26146-26581"<br>/label="orf(4,280937,66,93)$zz$ORF @ 26146-26581 CDS" |
| | | CDS | 4107..5306<br>/product="orf(4,280937,66,88)$zz$ORF @ 24925-26125"<br>/label="orf(4,280937,66,88)$zz$ORF @ 24925-26125 CDS" |
| | | Annotated | complement(4134..5135)<br>/product="-> pfam07726(45,179)[205.0] \| COG0714(7,330)[290.3] : A(4,280937,66,16)$zz$MoxR-like ATPase & KO:K03924"<br>/label="-> pfam07726(45,179)[205.0] \| COG0714(7,330)[290.3] : A(4,280937,66,16)$zz$MoxR-like ATPase & KO:K03924 CDS" |
| | | Questional_CDS | 4159..4482<br>/product="orf(4,280937,66,91)$zz$ORF @ 25749-26073"<br>/label="orf(4,280937,66,91)$zz$ORF @, 25749-26073 CDS" |
| | | Questional_CDS | 4735..5052<br>/product="orf(4,280937,66,90)$zz$ORF @ 25179-25497"<br>/label="orf(4,280937,66,90)$zz$ORF @ 25179-25497 CDS" |
| | | Questional_CDS | complement(5149..6018)<br>/product="orf(4,280937,66,85)$zz$ORF @ 24213-25083"<br>/label="orf(4,280937,66,85)$zz$ORF @ 24213-25083 CDS" |
| | | Questional_CDS | complement(5274..5924)<br>/product="orf(4,280937,66,87)$zz$ORF @ 24307-24958"<br>/label="orf(4,280937,66,87)$zz$ORF @ 24307-24958 CDS" |
| | | Annotated | 5536..5955<br>/product="-> pfam00072(5,116)[30.1] \| COG2197(3,131)[32.9]: A(4,280937,66,15)$zz$DNAbinding NarL/FixJ familyresponse regulator & COG2197" /label="-> pfam00072(5,116)[30.1] \| COG2197(3,131)[32.9]: A(4,280937,66,15)$zz$DNA-binding NarL/FixJ Family response regulator & COG2197 CDS" |
| | | Questional_CDS | complement(5972..6187)<br>/product="orf(4,280937,66,84)$zz$ORF @ 24044-24260"<br>/label="orf(4,280937,66,84)$zz$ORF @ 24044-24260 CDS" |
| | | Questional_CDS | 5994..6191<br>/product="orf(4,280937,66,83)$zz$ORF @ 24040-24238"<br>/label="orf(4,280937,66,83)$zz$ORF @ 24040-24238 CDS" |
| | | Annotated | complement(6042..7844)<br>/product="-> pfam00884(5,374)[177.8] \| COG3119(1,479)[215.2] : orf(4,280937,66,80)$zz$ORF @ 22387-24190"<br>/label="-> pfam00884(5,374)[177.8] \| COG3119(1,479)[215.2] : orf(4,280937,66,80)$zz$ORF @ 22387-24190 CDS" |
| | | Questional_CDS | complement(6184..7329)<br>/product="orf(4,280937,66,81)$zz$ORF @ 22902-24048"<br>/label="orf(4,280937,66,81)$zz$ORF @ 22902-24048 CDS" |
| | | CDS | 6330..7874<br>/product="orf(4,280937,66,79)$zz$ORF @ 22357-23902"<br>/label="orf(4,280937,66,79)$zz$ORF @ 22357-23902 CDS" |
| | | Questional_CDS | 6337..6639<br>/product="orf(4,280937,66,82)$zz$ORF @ 23592-23895"<br>/label="orf(4,280937,66,82)$zz$ORF @ 23592-23895 CDS" |
| | | CDS | complement(7336..8874)<br>/product="orf(4,280937,66,76)$zz$ORF @ 21357-22896"<br>/label="orf(4,280937,66,76)$zz$ORF @ 21357-22896 CDS" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | Annotated | 7477..8838<br>/product="-> pfam01408(4,120)[62.0] \| COG0673(1,363)[129.8] : orf(4,280937,66,77)$zz$ORF @ 21393-22755"<br>/label="-> pfam01408(4,120)[62.0] \| COG0673(1,363)[129.8] : orf(4,280937,66,77)$zz$ORF @ 21393-22755 CDS" |
| | | Questional_CDS | 7871..8062<br>/product="orf(4,280937,66,78)$zz$ORF @ 22169-22361"<br>/label="orf(4,280937,66,78)$zz$ORF @ 22169-22361 CDS" |
| | | Questional_CDS | 7962..8909<br>/product="orf(4,280937,66,75)$zz$ORF @ 21322-22270"<br>/label="orf(4,280937,66,75)$zz$ORF @ 21322-22270 CDS" |
| | | Questional_CD | complement(8483..8914)<br>/product="orf(4,280937,66,74)$zz$ORF @ 21317-21749"<br>/label="orf(4,280937,66,74)$zz$ORF @ 21317-21749 CDS" |
| | | Questional_CD | complement(8835..9263)<br>/product="orf(4,280937,66,71)$zz$ORF @ 20968-21397"<br>/label="orf(4,280937,66,71)$zz$ORF @, 20968-21397 CDS" |
| | | Questional_CD | 8873..9226<br>/product="orf(4,280937,66,72)$zz$ORF @ 21005-21359"<br>/label="orf(4,280937,66,72)$zz$ORF @ 21005-21359 CDS" |
| | | Questional_CD | complement(8899..9138)<br>/product="orf(4,280937,66,73)$zz$ORF @ 21093-21333"<br>/label="orf(4,280937,66,73)$zz$ORF @ 21093-21333 CDS" |
| | | Questional_CD | complement(9107..9460)<br>/product="orf(4,280937,66,70)$zz$ORF @ 20771-21125"<br>/label="orf(4,280937,66,70)$zz$ORF @ 20771-21125 CDS" |
| | | CDS | 9243..10466 /product="orf(4,280937,66,66)$zz$ORF @ 19765-20989"<br>/label="orf(4,280937,66,66)$zz$ORF @ 19765-20989 CDS" |
| | | Questional_CDS | complement(9711..9959)<br>/product="orf(4,280937,66,69)$zz$ORF @ 20272-20521"<br>/label="orf(4,280937,66,69)$zz$ORF @ 20272-20521 CDS" |
| | | Questional_CDS | complement(9776..10081)<br>/product="orf(4,280937,66,67)$zz$ORF @ 20150-20456"<br>/label="orf(4,280937,66,67)$zz$ORF @ 20150-20456 CDS" |
| | | Questional_CDS | Questional_CDS 9782..9976<br>/product="orf(4,280937,66,68)$zz$ORF @ 20255-20450"<br>/label="orf(4,280937,66,68)$zz$ORF @ 20255-20450 CDS" |
| | | POI | 10000..11919<br>/product="-> IscB(3,424)[178.9] \| pfam14279(283,338)[46.4]\| pfam14239(1,76)[38.0] \| pfam14239(135,263)[31.3] \|COG1403(228,339)[43.6] :A(4,280937,66,12)$zz$5-methylcytosine-specific restrictionendonuclease McrA & COG1403"<br>/label="-> IscB(3,424)[178.9] \| pfam14279(283,338)[46.4]\| pfam14239(1,76)[38.0] \| pfam14239(135,263)[31.3] \|COG1403(228,339)[43.6] :A(4,280937,66,12)$zz$5-methylcytosine-specific restriction endonuclease McrA & COG1403 POI" |
| | | Annotated | 10000..11919<br>/product="-> IscB(3,424)[178.9] \| pfam14279(283,338)[46.4]\| pfam14239(1,76)[38.0] \| pfam14239(135,263)[31.3] \|COG1403(228,339)[43.6] :A(4,280937,66,12)$zz$5-methylcytosine-specific restrictionendonuclease McrA & COG1403" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | | /label="–> IscB(3,424)[178.9] \| pfam14279(283,338)[46.4]\| pfam14239(1,76)[38.0] \| pfam14239(135,263)[31.3] \|COG1403(228,339)[43.6] :A(4,280937,66,12)$zz$5-methylcytosine-specificrestrictionendonuclease McrA & COG1403 CDS" |
| | | Questional_CDS | complement(10267..10593) /product="orf(4,280937,66,65)$zz$ORF @ 19638-19965" /label="orf(4,280937,66,65)$zz$ORF @ 19638-19965 CDS" |
| | | Questional_CDS | 10427..10648 /product="orf(4,280937,66,64)$zz$ORF @ 19583-19805" /label="orf(4,280937,66,64)$zz$ORF @ 19583-19805 CDS" |
| | | Questional_CDS | complement(11053..11247) /product="orf(4,280937,66,63)$zz$ORF @ 18984-19179" /label="orf(4,280937,66,63)$zz$ORF @ 18984-19179 CDS" |
| | | Questional_CDS | complement(11281..11691) /product="orf(4,280937,66,62)$zz$ORF @ 18540-18951" /label="orf(4,280937,66,62)$zz$ORF @ 18540-18951 CDS" |
| | | Questional_CDS | complement(11783..12019) /product="orf(4,280937,66,60)$zz$ORF @ 18212-18449" /label="orf(4,280937,66,60)$zz$ORF @ 18212-18449 CDS" |
| | | Questional_CDS | complement(11824..12063) /product="orf(4,280937,66,59)$zz$ORF @ 18168-18408" /label="orf(4,280937,66,59)$zz$ORF @ 18168-18408 CDS" |
| | | DR | 11944..11967 /label="DR" |
| | | DR | 12005..12028 /label="DR" |
| | | DR | 12066..12089 /label="DR" |
| | | DR | 12129..12152 /label="DR" |
| | | DR | 12189..12212 /label="DR" |
| | | DR | 12250..12273 /label="DR" |
| | | Questional_CDS | 12268..12687 /product="orf(4,280937,66,58)$zz$ORF @ 17544-17964" /label="orf(4,280937,66,58)$zz$ORF @ 17544-17964 CDS" |
| | | Questional_CDS | complement(12297..12764) /product="orf(4,280937,66,57)$zz$ORF @ 17467-17935" /label="orf(4,280937,66,57)$zz$ORF @ 17467-17935 CDS" |
| | | Questional_CDS | complement(12460..13068) /product="orf(4,280937,66,56)$zz$ORF @ 17163-17772" /label="orf(4,280937,66,56)$zz$ORF @ 17163-17772 CDS" |
| | | CDS | 12709..14451 /product="orf(4,280937,66,53)$zz$ORF @ 15780-17523" /label="orf(4,280937,66,53)$zz$ORF @ 15780-17523 CDS" |
| | | CDS | complement(12776..15607) /product="orf(4,280937,66,49)$zz$ORF @ 14624-17456" /label="orf(4,280937,66,49)$zz$ORF @ 14624-17456 CDS" |
| | | Annotated | 12788..14398 /product="–> pfam00149(269,459)[47.7] : A(4,280937,66,11)$zz$calcineurin-like phosphoesterase family protein & pfam00149" /label="–> pfam00149(269,459)[47.7] : A(4,280937,66,11)$zz$calcineurin-like phosphoesterase family protein & pfam00149 CDS" |
| | | Questional_CDS | complement(13141..13479) /product="orf(4,280937,66,55)$zz$ORF @ 16752-17091" /label="orf(4,280937,66,55)$zz$ORF @ 16752-17091 CDS" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | Questional_CDS | complement(14293..14688)<br>/product="orf(4,280937,66,51)$zz$ORF @ 15543-15939"<br>/label="orf(4,280937,66,51)$zz$ORF @ 15543-15939 CDS" |
| | | Questional_CDS | complement(14370..14672)<br>/product="orf(4,280937,66,52)$zz$ORF @ 15559-15862"<br>/label="orf(4,280937,66,52)$zz$ORF @ 15559-15862 CDS" |
| | | Annotated | 14687..16282<br>/product="-> pfam00939(76,529)[146.5] \| COG0471(18,528)[162.0] : A(4,280937,66,10)$zz$sodium-dependent Dicarboxylate transporter 2/3/5 & KO:K14445"<br>/label="-> pfam00939(76,529)[146.5] \| COG0471(18,528)[162.0] : A(4,280937,66,10)$zz$sodium-dependent Dicarboxylate transporter 2/3/5 & KO:K14445 CDS" |
| | | Questional_CDS | complement(14755..15318)<br>/product="orf(4,280937,66,50)$zz$ORF @ 14913-15477"<br>/label="orf(4,280937,66,50)$zz$ORF @ 14913-15477 CDS" |
| | | Questional_CDS | /product="orf(4,280937,66,48)$zz$ORF @ 14451-14724"<br>/label="orf(4,280937,66,48)$zz$ORF @ 14451-14724 CDS" |
| | | Questional_CDS | complement(15683..16366)<br>/product="orf(4,280937,66,45)$zz$ORF @ 13865-14549"<br>/label="orf(4,280937,66,45)$zz$ORF @ 13865-14549 CDS" |
| | | Questional_CDS | complement(15781..16122)<br>/product="orf(4,280937,66,47)$zz$ORF @ 14109-14451"<br>/label="orf(4,280937,66,47)$zz$ORF @ 14109-14451 CDS" |
| | | Questional_CDS | complement(16185..16931)<br>/product="orf(4,280937,66,43)$zz$ORF @ 13300-14047"<br>/label="orf(4,280937,66,43)$zz$ORF @ 13300-14047 CDS" |
| | | CDS | 16365..16730<br>/product="A(4,280937,66,9)$zz$hypothetical protein"<br>/label="A(4,280937,66,9)$zz$hypothetical protein CDS" |
| | | Questional_CDS | 16604..17050<br>/product="orf(4,280937,66,42)$zz$ORF @ 13181-13628"<br>/label="orf(4,280937,66,42)$zz$ORF @ 13181-13628 CDS" |
| | | Questional_CDS | complement(16826..17143)<br>/product="orf(4,280937,66,41)$zz$ORF @ 13088-13406"<br>/label="orf(4,280937,66,41)$zz$ORF @ 13088-13406 CDS" |
| | | CDS | complement(17136..18977)<br>/product="orf(4,280937,66,37)$zz$ORF @ 11254-13096"<br>/label="orf(4,280937,66,37)$zz$ORF @ 11254-13096 CDS" |
| | | Annotated | 17310..18764<br>/product="-> pfam00171(5,476)[443.4] \| COG1012(1,483)[454.5] : A(4,280937,66,8)$zz$malonate-semialdehyde dehydrogenase (acetylating)/methylmalonate-semialdehyde dehydrogenase & KO:K00140"<br>/label="-> pfam00171(5,476)[443.4] \| COG1012(1,483)[454.5] : A(4,280937,66,8)$zz$malonate-semialdehyde dehydrogenase (acetylating)/methylmalonate-semialdehyde dehydrogenase & KO:K00140 CDS" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | Questional_CDS | complement(17495..18148)<br>/product="orf(4,280937,66,40)$zz$ORF @ 12083-12737"<br>/label="orf(4,280937,66,40)$zz$ORF @ 12083-12737 CDS" |
| | | Questional_CDS | 17825..18862<br>/product="orf(4,280937,66,38)$zz$ORF @ 11369-12407"<br>/label="orf(4,280937,66,38)$zz$ORF @ 11369-12407 CDS" |
| | | Questional_CDS | complement(18736..19164)<br>/product="orf(4,280937,66,36)$zz$ORF @ 11067-11496"<br>/label="orf(4,280937,66,36)$zz$ORF @ 11067-11496 CDS" |
| | | CDS | complement(19007..20755)<br>/product="orf(4,280937,66,31)$zz$ORF @ 9476-11225"<br>/label="orf(4,280937,66,31)$zz$ORF @ 9476-11225 CDS" |
| | | Annotated | 19013..20122<br>/product="-> pfam02317(185,336)[103.9] : A(4,280937,66,7)$zz$opine dehydrogenase & KO:K04940"<br>/label="-> pfam02317(185,336)[103.9] : A(4,280937,66,7)$zz$opine dehydrogenase & KO:K04940 CDS"<br>Questional_CDS 19168..19839<br>/product="orf(4,280937,66,34)$zz$ORF @ 10392-11064"<br>/label="orf(4,280937,66,34)$zz$ORF @ 10392-11064 CDS" |
| | | Questional_CDS | complement(19348..19626)<br>/product="orf(4,280937,66,35)$zz$ORF @ 10605-10884"<br>/label="orf(4,280937,66,35)$zz$ORF @, 10605-10884 CDS" |
| | | Questional_CDS | complement(20098..20427)<br>/product="orf(4,280937,66,32)$zz$ORF @ 9804-10134"<br>/label="orf(4,280937,66,32)$zz$ORF @ 9804-10134 CDS" |
| | | Questional_CDS | complement(20795..20971)<br>/product="orf(4,280937,66,30)$zz$ORF @ 9260-9437"<br>/label="orf(4,280937,66,30)$zz$ORF @ 9260-9437 CDS" |
| | | Questional_CDS | complement(20998..21327)<br>/product="orf(4,280937,66,29)$zz$ORF @ 8904-9234"<br>/label="orf(4,280937,66,29)$zz$ORF @ 8904-9234 CDS |
| 87 | 0315285__10000442__organized (Accession 0315285__10000442) | Padding | <1..2945<br>/label |
| | | CDS | 2948..3055<br>/product="A(7,281636,441,0)$zz$hypothetical protein" |
| | | CDS | 3140..3283<br>/product="A(7,281636,441,1)$zz$hypothetical protein" |
| | | Annotated | 3314..3736<br>/product="-> pfam08241(3,76)[39.7] | COG2227(2,111)[28.3] : A(7,281636,441,2)$zz$2-polyprenyl-3-methyl-5-hydroxy-6-meto xy-1,4-benz oquinol methylase & COG2227" |
| | | Questional_CDS | complement(3440..3625)<br>/product="orf(7,281636,441,0)$zz$ORF @ 494-680" |
| | | Questional_CDS | complement(3622..3837)<br>/product="orf(7,281636,441,1)$zz$ORF @ 676-892" |
| | | Questional_CDS | complement(3641..4003)<br>/product="orf(7,281636,441,2)$zz$ORF @ 695-1058" |
| | | Questional_CDS | 3726..4076<br>/product="orf(7,281636,441,3)$zz$ORF @ 780-1131" |
| | | Questional_CDS | 3811..4740<br>/product="orf(7,281636,441,4)$zz$ORF @ 865-1795" |
| | | CDS | complement(3937..5196)<br>/product="A(7,281636,441,3)$zz$hypothetical protein" |
| | | Questional_CDS | 4004..4213<br>/product="orf(7,281636,441,6)$zz$ORF @ 1058-1268" |
| | | Questional_CDS | 5244..5966<br>/product="orf(7,281636,441,7)$zz$ORF @ 2298-3021" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | CDS | complement(5472..6722) /product="A(7,281636,441,4)$zz$hypothetical protein" |
| | | Questional_CDS | 5566..5790 /product="orf(7,281636,441,9)$zz$ORF @ 2620-2845" |
| | | Questional_CDS | complement(5612..5806) /product="orf(7,281636,441,10)$zz$ORF @ 2666-2861" |
| | | Questional_CDS | complement(5998..6255) /product="orf(7,281636,441,11)$zz$ORF @ 3052-3310" |
| | | Questional_CDS | 6064..6294 /product="orf(7,281636,441,12)$zz$ORF @ 3118-3349" |
| | | Questional_CDS | 6099..6983 /product="orf(7,281636,441,13)$zz$ORF @ 3153-4038" |
| | | Questional_CDS | 6445..6759 /product="orf(7,281636,441,14)$zz$ORF @ 3499-3814" |
| | | Questional_CDS | 6775..7230 /product="orf(7,281636,441,15)$zz$ORF @ 3829-4285" |
| | | Questional_CDS | 6875..7117 /product="orf(7,281636,441,16)$zz$ORF @ 3929-4172" |
| | | Questional_CDS | complement(7013..8161) /product="orf(7,281636,441,17)$zz$ORF @ 4067-5216" |
| | | Annotated | complement(7099..9636) /product="-> pfam00176(205,524)[129.8] \| pfam00271(533,645)[63.9] \| COG0553(200,690) [300.4] : A(7,281636,441,6)$zz$SNF2 family DNA or RNA helicase & COG0553" |
| | | Questional_CDS | 8074 /product="orf(7,281636,441,19)$zz$ORF @, 4286-5129" |
| | | CDS | 7426..9906 /product="orf(7,281636,441,20)$zz$ORF @ 4480-6961" |
| | | Questional_CDS | complement(8760..9248) /product="orf(7,281636,441,21)$zz$ORF @ 5814-6303" |
| | | Questional_CDS | 9437..9658 /product="orf(7,281636,441,22)$zz$ORF @ 6491-6713" |
| | | Questional_CDS | complement(9518..9697) /product="orf(7,281636,441,23)$zz$ORF @ 6572-6752" |
| | | Questional_CDS | complement(9655..9915) /product="orf(7,281636,441,24)$zz$ORF @ 6709-6970" |
| | | Questional_CDS | 10021 /product="orf(7,281636,441,25)$zz$ORF @ 6713-7076" |
| | | Questional_CDS | 9720..9965 /product="orf(7,281636,441,26)$zz$ORF @ 6774-7020" |
| | | POI | 10000..11919 /product="-> IscB(3,65)[48.9] \| IscB(204,425) [131.0] \|pfam14279(283,338)[44.6] \| pfam14239(134,263) [36.5] \| pfam14239(1,81)[35.4] \| COG1403(241,343)[47.1]: A(7,281636,441,7)$zz$5-methylcytosine-specific restriction endonuclease McrA & COG1403" |
| | | Annotated | 10000..11919 /product="-> IscB(3,65)[48.9] \| IscB(204,425) [131.0] \| pfam14279(283,338)[44.6] \| pfam14239(134,263) [36.5] \| pfam14239(1,81)[35.4] \|COG1403(241,343)[47.1] : A(7,281636,441,7)$zz$5-methylcytosine-specific restriction endonuclease McrA & COG1403" |
| | | Questional_CDS | complement(10078..10698) /product="orf(7,281636,441,28)$zz$ORF @ 7132-7753" |
| | | Questional_CDS | complement(10506..10709) /product="orf(7,281636,441,29)$zz$ORF @ 7560-7764" |
| | | Questional_CDS | complement 10771..11394) /product="orf(7,281636,441,30)$zz$ORF @ 7825-8449" |
| | | Questional_CDS | complement(10851..11126) /product="orf(7,281636,441,31)$zz$ORF @ 7905-8181" |
| | | Questional_CDS | 11935..12231) /product="orf(7,281636,441,32)$zz$ORF @ 8989-9286" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | DR | 11941..11969 |
| | | DR | 12002..12030 |
| | | DR | 12062..12090 |
| | | DR | 12123..12151 |
| | | Questional_CDS | complement(12180..12413) /product="orf(7,281636,441,33)$zz$ORF @ 9234-9468" |
| | | | 12184..12212 |
| | | | 12245..12273 |
| | | | 12306..12334 |
| | | | 12368..12396 |
| | | | 12430..12458 |
| | | Questional_CDS | 12452..12832 /product="orf(7,281636,441,34)$zz$ORF @ 9506-9887" |
| | | DR | 12490..12518 |
| | | Questional_CDS | complement(12606..12896) /product="orf(7,281636,441,35)$zz$ORF @ 9660-9951" |
| | | Questional_CDS | 12727..12909 /product="orf(7,281636,441,36)$zz$ORF @ 9781-9964" |
| | | CDS | 13167..13823 /product="A(7,281636,441,8)$zz$hypothetical protein" |
| | | Questional_CDS | complement(13229..13435) /product="orf(7,281636,441,38)$zz$ORF @ 10283-10490" |
| | | Questional_CDS | complement(13408..13689) /product="orf(7,281636,441,39)$zz$ORF @ 10462-10744" |
| | | CDS | complement(13902..14051) /product="A(7,281636,441,9)$zz$hypothetical protein" |
| | | Annotated | complement(14055..14585) /product="--> pfam00011(104,176)[21.4] COG0071(63,176)[57.0] : A(7,281636,441,10)$zz$HSP20 family protein & KO:K13993" |
| | | Questional_CDS | 14254..14727 /product="orf(7,281636,441,41)$zz$ORF @ 11308-11782" |
| | | Questional_CDS | 14325..14624 /product="orf(7,281636,441,42)$zz$ORF @ 11379-11679" |
| | | Questional_CDS | complement(14471..14641) /product="orf(7,281636,441,43)$zz$ORF @ 11525-11696" |
| | | Annotated | complement(14681..17068) /product="--> pfam00012(4,598)[633.7] | COG0443(1,601)[620.3] : orf(7,281636,441,44)$zz$ORF @ 11735-14123" |
| | | Questional_CDS | complement(14923..15267) /product="orf(7,281636,441,45)$zz$ORF @ 11977-12322" |
| | | Questional_CDS | 15420..15689 /product="orf(7,281636,441,46)$zz$ORF @ 12474-12744" |
| | | Questional_CDS | complement(15655..15852) /product="orf(7,281636,441,47)$zz$ORF @ 12709-12907" |
| | | Questional_CDS | 15794..16537 /product="orf(7,281636,441,48)$zz$ORF @ 12848-13592" |
| | | Questional_CDS | complement(16216..16383) /product="orf(7,281636,441,49)$zz$ORF @ 13270-13438" |
| | | Questional_CDS | 16248..16826 /product="orf(7,281636,441,50)$zz$ORF @ 13302-13881" |
| | | Questional_CDS | complement(16494..16667) /product="orf(7,281636,441,51)$zz$ORF @ 13548-13722" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | Questional_CDS | 16556..17002<br>/product="orf(7,281636,441,52)$zz$ORF @ 13610-14057" |
| | | Annotated | complement(16621..16923)<br>/product="–> pfam00741(13,51)[46.5] :<br>A(7,281636,441,12)$zz$gas vesicle protein GvpA/ GvpJ/GvpM family & pfam00741" |
| | | CDS | 16950..18155<br>/product="orf(7,281636,441,54)$zz$ORF @ 14004-15210" |
| | | Annotated | complement(16962..17771)<br>/product="–> pfam06386(18,268)[220.6] :<br>A(7,281636,441,13)$zz$gas vesicle protein GvpL/ GvpF & pfam06386" |
| | | Questional_CDS | complement(17090..17764)<br>/product="orf(7,281636,441,56)$zz$ORF @ 14144-14819" |
| | | Questional_CDS | 17717..18346<br>/product="orf(7,281636,441,57)$zz$ORF @ 14771-15401" |
| | | Annotated | complement(17768..18112)<br>/product="–> pfam05121(1,88)[65.9] :<br>A(7,281636,441,14)$zz$gas vesicle protein GvpK & pfam05121" |
| | | Annotated | complement(18109..18837)<br>/product="–> COG0071(139,242)[42.4] :<br>A(7,281636,441,15)$zz$HSP20 family molecular chaperone IbpA & COG0071" |
| | | Questional_CDS | 18133..18924<br>/product="orf(7,281636,441,60)$zz$ORF @ 15187-15979" |
| | | Questional_CDS | 18645..19664<br>/product="orf(7,281636,441,61)$zz$ORF @ 15699-16719" |
| | | Questional_CDS | 18725..19336<br>/product="orf(7,281636,441,62)$zz$ORF @ 15779-16391" |
| | | Questional_CDS | complement(18783..18998)<br>/product="orf(7,281636,441,63)$zz$ORF @ 15837-16053 |
| | | Questional_CDS | complement(18844..19011)<br>/product="orf(7,281636,441,64)$zz$ORF @ 15898-16066" |
| | | Annotated | complement(18899..19264)<br>/product="–> pfam00741(16,54)[61.5] :<br>A(7,281636,441,16)$zz$gas vesicle protein GvpA/ GvpJ/GvpM family & pfam00741" |
| | | Annotated | complement(19266..19550)<br>/product="–> pfam05800(2,84)[73.8] :<br>A(7,281636,441,17)$zz$gas vesicle protein GvpO & pfam05800" |
| | | Questional_CDS | 19538..19708 /product="orf(7,281636,441,67)$zz$ORF @ 16592-16763" |
| | | Questional_CDS | 19549..20619<br>/product="orf(7,281636,441,68)$zz$ORF @ 16603-17674" |
| | | Annotated | complement(19585..20088)<br>/product="–> pfam05120(5,83)[51.2] :<br>orf(7,281636,441,69)$zz$ORF @ 16639-17143" |
| | | Questional_CDS | 19833..20696<br>/product="orf(7,281636,441,70)$zz$ORF @ 16887-17751" |
| | | Annotated | complement(19842..20711)<br>/product="–> pfam06386(28,282)[174.9] :<br>A(7,281636,441,19)$zz$gas vesicle protein GvpL/ GvpF & pfam06386" |
| | | Annotated | complement(20728..21837)<br>/product="–> pfam06386(5,249)[178.9] \|<br>pfam00226(265,317)[41.7] \| COG0484(261,318) [41.9] :<br>A(7,281636,441,20)$zz$DnaJ-class molecular chaperone & COG0484" |
| | | Questional_CDS | complement(20883..21146)<br>/product="orf(7,281636,441,74)$zz$ORF @ 17937-18201" |
| | | Questional_CDS | 21260..21499<br>/product="orf(7,281636,441,75)$zz$ORF @ 18314-18554" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| 88 | 0114922_10016519_organized (Accession 0114922_10016519) | Padding | <1..9498 /label |
| | | Annotated | complement(9499..9729) /product="-> pfam04794(9,55)[49.5] \| COG3394(7,54)[44.6] :A(12,22447,16518,0)$zz$Predicted glycoside hydrolase ordeacetylase ChbG, UPF0249 family & COG3394" |
| | | Questional_CDS | 9500..9883 /product="orf(12,22447,16518,1)$zz$Partial ORF @ 1-385" |
| | | Questional_CDS | complement(9500..9769) /product="orf(12,22447,16518,2)$zz$Partial ORF @ 1-271" |
| | | Questional_CDS | complement(9501..9725) /product="orf(12,22447,16518,3)$zz$Partial ORF @ 2-227" |
| | | Questional_CDS | 9514..9948 /product="orf(12,22447,16518,4)$zz$Partial ORF @ 15-450" |
| | | Questional_CDS | complement(9940..10125) /product="orf(12,22447,16518,5)$zz$ORF @ 441-627" |
| | | POI | 10000..12228 /product="-> IscB(101,547)[186.8] : orf(12,22447,16518,6)$zz$ORF @ 501-2730" |
| | | Annotated | 10000..12228 /product="-> IscB(101,547)[186.8] : orf(12,22447,16518,6)$zz$ORF @ 501-2730" |
| | | Questional_CDS | complement(10070..10237) /product="orf(12,22447,16518,7)$zz$ORF @ 571-739" |
| | | CDS | 10173..12476 /product="orf(12,22447,16518,8)$zz$ORF @ 674-2978" |
| | | CDS | complement(10234..11535) /product="orf(12,22447,16518,9)$zz$ORF @ 735-2037" |
| | | Questional_CDS | complement(10701..11120) /product="orf(12,22447,16518,10)$zz$ORF @ 1202-1622" |
| | | Questional_CDS | complement(11145..11462) /product="orf(12,22447,16518,11)$zz$ORF @ 1646-1964" |
| | | Questional_CDS | 12157 /product="orf(12,22447,16518,12)$zz$ORF @ 2389-2659" |
| | | DR | 12233..12260 |
| | | Questional_CDS | complement(12259..12600) /product="orf(12,22447,16518,13)$zz$ORF @ 2760-3102" |
| | | DR | 12294..12321 |
| | | DR | 12355..12382 |
| | | Questional_CDS | 12380..12583 /product="orf(12,22447,16518,14)$zz$ORF @ 2881-3085" |
| | | DR | 12416..12443 |
| | | DR | 12477..12504 |
| | | Questional_CDS | complement(12536..12820) /product="orf(12,22447,16518,15)$zz$ORF @ 3037-3322" |
| | | DR | 12538..12565 |
| | | CDS | 12590..12817 /product="A(12,22447,16518,2)$zz$hypothetical protein & Hypo-rule applied" |
| | | DR | 12599..12626 |
| | | Questional_CDS | complement(12631..12852) /product="orf(12,22447,16518,16)$zz$ORF @ 3132-3354" |
| | | DR | 12660..12689 |
| | | DR | 12723..12750 |
| | | DR | 12785..12812 |
| | | Questional_CDS | 12810..13247 /product="orf(12,22447,16518,17)$zz$ORF @ 3311-3749" |
| | | CDS | complement(13311..13484) /product="A(12,22447,16518,3)$zz$hypothetical protein & Hypo-rule applied" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | Questional_CDS | 13473..13724<br>/product="orf(12,22447,16518,19)$zz$ORF @ 3974-4226" |
| | | CDS | 13508..13954<br>/product="A(12,22447,16518,4)$zz$hypothetical protein &<br>Hypo-rule applied"<br>Questional_CDS complement(13879..14055)<br>/product="orf(12,22447,16518,21)$zz$ORF @ 4380-4557" |
| | | Questional_CDS | complement(13955..14419)<br>/product="orf(12,22447,16518,22)$zz$ORF @ 4456-4921" |
| | | CDS | 14003..14335<br>/product="A(12,22447,16518,5)$zz$hypothetical protein & Hypo-rule applied" |
| | | Questional_CDS | 14332..14568<br>/product="orf(12,22447,16518,24)$zz$ORF @ 4833-5070" |
| | | CDS | complement(14461..14685)<br>/product="A(12,22447,16518,6)$zz$hypothetical protein & Hypo-rule applied" |
| | | Questional_CDS | 14600..14833<br>/product="orf(12,22447,16518,26)$zz$ORF @ 5101-5335" |
| | | CDS | 14785..15468<br>/product="A(12,22447,16518,7)$zz$hypothetical protein & Hypo-rule applied" |
| | | Questional_CDS | complement(14970..15941)<br>/product="orf(12,22447,16518,28)$zz$ORF @ 5471-6443" |
| | | Questional_CDS | complement(15509..15709)<br>/product="orf(12,22447,16518,29)$zz$ORF @ 6010-6211" |
| | | Questional_CDS | 15648..16112<br>/product="orf(12,22447,16518,30)$zz$ORF @ 6149-6614" |
| | | Questional_CDS | 15682..15891<br>/product="orf(12,22447,16518,31)$zz$ORF @ 6183-6393" |
| | | Questional_CDS | complement(15948..16157)<br>/product="orf(12,22447,16518,32)$zz$Partial ORF @ 6449-6659" |
| | | CDS | 16058..16156<br>/product="A(12,22447,16518,8)$zz$hypothetical protein & Hypo-rule applied" |
| 89 | 0315277_10040887_organized (Accession 0315277_10040887) | Padding | <1..8170<br>/label |
| | | Questional_CDS | 8172..8633<br>/product="orf(7,281628,40886,0)$zz$Partial ORF @ 1-463" |
| | | Questional_CDS | complement(8883..9854)<br>/product="orf(7,281628,40886,1)$zz$ORF @ 712-1684" |
| | | Questional_CDS | 8928..9287<br>/product="orf(7,281628,40886,2)$zz$ORF @ 757-1117" |
| | | Questional_CDS | 8981..9433)<br>/product="orf(7,281628,40886,3)$zz$ORF @ 810-1263" |
| | | DR | 8984..9011 |
| | | DR | 9048..9075 |
| | | DR | 9109..9136 |
| | | DR | 9170..9197 |
| | | DR | 9232..9259 |
| | | DR | 9295..9322 |
| | | Questional_CDS | complement(9322..9753)<br>/product="orf(7,281628,40886,4)$zz$ORF @ 1151-1583" |
| | | DR | 9359..9386 |
| | | Questional_CDS | 9394..9702<br>/product="orf(7,281628,40886,5)$zz$ORF @ 1223-1532" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | DR | 9420..9447 |
| | | Questional_CDS | 9470..9676 /product="orf(7,281628,40886,6)$zz$ORF @ 1299-1506" |
| | | DR | 9481..9508 |
| | | DR | 9542..9569 |
| | | DR | 9603..9630 |
| | | Questional_CDS | complement(9892..10545) /product="orf(7,281628,40886,7)$zz$ORF @ 1721-2375" |
| | | POI | 10000..12018 /product="-> IscB(4,71)[53.7] \| IscB(240,571) [109.3] \| pfam14279(323,378)[40.0] \| pfam14239(1,80)[39.1] \| COG1403(299,388)[29.9] : A(7,281628,40886,0)$zz$5-methylcytosine-specific restriction endonuclease McrA & COG1403" |
| | | Annotated | 10000..12018 /product="-> IscB(4,71)[53.7] \| IscB(240,571) [109.3] \| pfam14279(323,378)[40.0] \| pfam14239(1,80)[39.1] \| COG1403(299,388)[29.9] : A(7,281628,40886,0)$zz$5-methylcytosine-specific restriction endonuclease McrA & COG1403" |
| | | Questional_CDS | complement(10188..10406) /product="orf(7,281628,40886,9)$zz$ORF @ 2017-2236" |
| | | Questional_CDS | 10350..10601 /product="orf(7,281628,40886,10)$zz$ORF @ 2179-2431" |
| | | Questional_CDS | 10455..10877) /product="orf(7,281628,40886,11)$zz$ORF @ 2284-2707" |
| | | Questional_CDS | 10881..11099 /product="orf(7,281628,40886,12)$zz$ORF @ 2710-2929" |
| | | Questional_CDS | complement(11458..12012) /product="orf(7,281628,40886,13)$zz$ORF @ 3287-3842" |
| | | Questional_CDS | complement(11571..11768) /product="orf(7,281628,40886,14)$zz$ORF @ 3400-3598" |
| | | Questional_CDS | 11585..11755 /product="orf(7,281628,40886,15)$zz$ORF @ 3414-3585" |
| | | Questional_CDS | complement(12573..13391) /product="orf(7,281628,40886,16)$zz$ORF @ 4402-5221" |
| | | Questional_CDS | 12603..12836 /product="orf(7,281628,40886,17)$zz$ORF @ 4432-4666" |
| | | Questional_CDS | complement(12773..12940) /product="orf(7,281628,40886,18)$zz$ORF @ 4602-4770" |
| | | Annotated | 12849..13625 /product="-> pfam11028(48,202)[132.7] : A(7,281628,40886,1)$zz$uncharacterized protein DUF2723 & pfam11028" |
| | | Questional_CDS | complement(13425..13598) /product="orf(7,281628,40886,20)$zz$Partial ORF @ 5254-5428" |
| 90 | 0315294_10042545_organized (Accession 0315294_10042545) | Padding | <1..9257 /label |
| | | Questional_CDS | 9260..9655 /product="orf(7,281645,42544,0)$zz$Partial ORF @ 2-398" |
| | | DR | 9314..9349 |
| | | DR | 9380..9415 |
| | | Questional_CDS | 9426..9593 /product="orf(7,281645,42544,1)$zz$ORF @ 168-336" |
| | | DR | 9446..9481 |
| | | DR | 9512..9547 |
| | | DR | 9577..9612 |
| | | DR | 9642..9677 |
| | | DR | 9708..9743 |
| | | POI | 10000..12309 /product="-> IscB(28,91)[44.2] \| IscB(277,565) [91.3] \| pfam14279(363,410)[40.4] \| pfam14239(21,101) [36.7] : A(7,281645,42544,0)$zz$HNH endonuclease/RRXRR protein & pfam14279,pfam14239" |
| | | Annotated | 10000..12309 /product="-> IscB(28,91)[44.2] \| IscB(277,565) [91.3] \| pfam14279(363,410)[40.4] \| pfam14239(21,101) [36.7] : A(7,281645,42544,0)$zz$HNH endonuclease/RRXRR protein & pfam14279,pfam14239" |
| | | Questional_CDS | complement(10161..10550) /product="orf(7,281645,42544,3)$zz$ORF @ 903-1293" |
| | | Questional_CDS | complement(10243..10638) /product="orf(7,281645,42544,4)$zz$ORF @ 985-1381" |
| | | Questional_CDS | 10313..10696 /product="orf(7,281645,42544,5)$zz$ORF @, 1055-1439" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | Questional_CDS | complement(10711..11070) /product="orf(7,281645,42544,6)$zz$ORF @ 1453-1813" |
| | | Questional_CDS | complement(11091..11315) /product="orf(7,281645,42544,7)$zz$ORF @ 1833-2058" |
| | | Questional_CDS | complement(11125..11415) /product="orf(7,281645,42544,8)$zz$ORF @ 1867-2158" |
| | | Questional_CDS | complement(12120..12470) /product="orf(7,281645,42544,9)$zz$ORF @ 2862-3213" |
| | | Annotated | 12705..13904 /product="-> pfam13784(45,127)[94.3] \| pfam02661(133,239)[74.0] \| pfam11972(322,376)[31.5] \| COG3177(24,377)[222.4] : A(7,281645,42544,1)$zz$Fic family protein & COG3177" |
| | | Questional_CDS | complement(13844..14104) /product="orf(7,281645,42544,12)$zz$Partial ORF @ 4586-4847" |
| 91 | a0315307_1000415_organized (Definition Ga0315307_1000415) | Questional_CDS | 174..764 /product="orf(4,281007,414,13)$zz$ORF @ 3184-3775" /label="orf(4,281007,414,13)$zz$ORF @ 3184-3775 CDS" |
| | | Questional_CDS | complement(222..533) /product="orf(4,281007,414,14)$zz$ORF @ 3232-3544" /label="orf(4,281007,414,14)$zz$ORF @ 3232-3544 CDS" |
| | | Questional_CDS | complement(496..681) /product="orf(4,281007,414,15)$zz$ORF @ 3506-3692" /label="orf(4,281007,414,15)$zz$ORF @ 3506-3692 CDS" |
| | | Questional_CDS | complement(696..920) /product="orf(4,281007,414,16)$zz$ORF @ 3706-3931" /label="orf(4,281007,414,16)$zz$ORF @ 3706-3931 CDS" |
| | | Questional_CDS | 891..1478 /product="orf(4,281007,414,17)$zz$ORF @ 3901-4489" /label="orf(4,281007,414,17)$zz$ORF @, 3901-4489 CDS" |
| | | Annotated | 919..4485 /product="-> pfam00395(847,882)[23.3] \| pfam00395(760,805)[16.8] : A(4,281007,414,3)$zz$S-layer family protein/S-layer family protein & pfam00395,pfam00395" /label="-> pfam00395(847,882)[23.3] \| pfam00395(760,805)[16.8] : A(4,281007,414,3)$zz$S-layer family protein/S-layer family protein & pfam00395,pfam00395 CDS" |
| | | CDS | complement(964..2433) /product="orf(4,281007,414,19)$zz$ORF @ 3974-5444" /label="orf(4,281007,414,19)$zz$ORF @ 3974-5444 CDS" |
| | | Questional_CDS | complement(1749..2060) /product="orf(4,281007,414,20)$zz$ORF @ 4759-5071" /label="orf(4,281007,414,20)$zz$ORF @ 4759-5071 CDS" |
| | | Questional_CDS | complement(2076..2273) /product="orf(4,281007,414,21)$zz$ORF @ 5086-5284" /label="orf(4,281007,414,21)$zz$ORF @ 5086-5284 CDS" |
| | | Questional_CDS | 2471..2710 /product="orf(4,281007,414,22)$zz$ORF @ 5481-5721" /label="orf(4,281007,414,22)$zz$ORF @ 5481-5721 CDS" |
| | | CDS | complement(2503..4152) /product="orf(4,281007,414,23)$zz$ORF @ 5513-7163" /label="orf(4,281007,414,23)$zz$ORF @ 5513-7163 CDS" |
| | | Questional_CDS | complement(2691..2957) /product="orf(4,281007,414,24)$zz$ORF @ 5701-5968" /label="orf(4,281007,414,24)$zz$ORF @, 5701-5968 CDS" |
| | | Questional_CDS | complement(4209..4421) /product="orf(4,281007,414,25)$zz$ORF @ 7219-7432" /label="orf(4,281007,414,25)$zz$ORF @ 7219-7432 CDS" |
| | | Questional_CDS | complement(4482..4946) /product="orf(4,281007,414,26)$zz$ORF @ 7492-7957" /label="orf(4,281007,414,26)$zz$ORF @ 7492-7957 CDS" |
| | | Questional_CDS | complement(4522..4692) /product="orf(4,281007,414,27)$zz$ORF @ 7532-7703" /label="orf(4,281007,414,27)$zz$ORF @ 7532-7703 CDS" |
| | | Annotated | 4636..6306 /product="-> pfam00395(292,335)[37.8] \| pfam00395(227,270)[34.1] : orf(4,281007,414,28)$zz$ORF @ 7646-9317" /label="-> pfam00395(292,335)[37.8] \| pfam00395(227,270)[34.1] : orf(4,281007,414,28)$zz$ORF @ 7646-9317 CDS" |
| | | Questional_CDS | 4679..4882 /product="orf(4,281007,414,29)$zz$ORF @ 7689-7893" /label="orf(4,281007,414,29)$zz$ORF @ 7689-7893 CDS" |
| | | Questional_CDS | complement(5056..6219) /product="orf(4,281007,414,30)$zz$ORF @ 8066-9230" /label="orf(4,281007,414,30)$zz$ORF @ 8066-9230 CDS" |
| | | Questional_CDS | 5951..6148 /product="orf(4,281007,414,31)$zz$ORF @ 8961-9159" /label="orf(4,281007,414,31)$zz$ORF @ 8961-9159 CDS" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | Questional_CDS | complement(6464..6670) /product="orf(4,281007,414,32)$zz$ORF @ 9474-9681" /label="orf(4,281007,414,32)$zz$ORF @ 9474-9681 CDS" |
| | | Questional_CDS | complement(6564..7352) /product="orf(4,281007,414,33)$zz$ORF @ 9574-10363" /label="orf(4,281007,414,33)$zz$ORF @ 9574-10363 CDS" |
| | | Annotated | 6645..7367 /product="–> pfam01522(58,197)[105.9] \| COG0726(7,232)[97.0] : A(4,281007,414,5)$zz$peptidoglycan/xylan/chitin deacetylase (PgdA/CDA1 family) & COG0726" /label="–> pfam01522(58,197)[105.9] \| COG0726(7,232)[97.0] : A(4,281007,414,5)$zz$peptidoglycan/xylan/chitin deacetylase (PgdA/CDA1 family) & COG0726 CDS" |
| | | Questional_CDS | 6859..7062 /product="orf(4,281007,414,35)$zz$ORF @ 9869-10073" /label="orf(4,281007,414,35)$zz$ORF @ 9869-10073 CDS" |
| | | Questional_CDS | 7180..7833 /product="orf(4,281007,414,36)$zz$ORF @ 10190-10844" /label="orf(4,281007,414,36)$zz$ORF @ 10190-10844 CDS" |
| | | Annotated | 7367..8455 /product="–> pfam00534(166,335)[135.7] \| pfam13439(15,159)[105.2] \| COG0438(3,360) [177.9] : A(4,281007,414,6)$zz$glycosyltransferase involved in cell wall biosynthesis & COG0438" /label="–> pfam00534(166,335)[135.7] \| pfam13439(15,159)[105.2] \| COG0438(3,360) [177.9] : A(4,281007,414,6)$zz$glycosyltransferase involved in cell wall biosynthesis & COG0438 CDS" |
| | | Questional_CDS | complement(7732..8421) /product="orf(4,281007,414,38)$zz$ORF @ 10742-11432" /label="orf(4,281007,414,38)$zz$ORF @ 10742-11432 CDS" |
| | | Questional_CDS | 7882..8502 /product="orf(4,281007,414,39)$zz$ORF @ 10892-11513" /label="orf(4,281007,414,39)$zz$ORF @ 10892-11513 CDS" |
| | | Questional_CDS | complement(8540..8893) /product="orf(4,281007,414,40)$zz$ORF @ 11550-11904" /label="orf(4,281007,414,40)$zz$ORF @ 11550-11904 CDS" |
| | | Questional_CDS | complement(8809..9057) /product="orf(4,281007,414,41)$zz$ORF @ 11819-12068" /label="orf(4,281007,414,41)$zz$ORF @ 11819-12068 CDS" |
| | | DR | 9076..9103 /label="DR" |
| | | DR | 9137..9164 /label="DR" |
| | | Questional_CDS | 9381 /product="orf(4,281007,414,42)$zz$ORF @ 12176-12392" /label="orf(4,281007,414,42)$zz$ORF @ 12176-12392 CDS" |
| | | Questional_CDS | 9170..9421 /product="orf(4,281007,414,43)$zz$ORF @ 12180-12432" /label="orf(4,281007,414,43)$zz$ORF @ 12180-12432 CDS" |
| | | DR | 9199..9226 /label="DR" |
| | | DR | 9260..9287 /label="DR" |
| | | DR | 9321..9348 /label="DR" |
| | | DR | 9382..9409 /label="DR" |
| | | DR | 9443..9470 /label="DR" |
| | | DR | 9504..9531 /label="DR" |
| | | DR | 9565..9592 /label="DR" |
| | | Questional_CDS | complement(9622..9963) /product="orf(4,281007,414,44)$zz$ORF @ 12632-12974" /label="orf(4,281007,414,44)$zz$ORF @ 12632-12974 CDS" |
| | | Questional_CDS | complement(9873..10181) /product="orf(4,281007,414,45)$zz$ORF @ 12883-13192" /label="orf(4,281007,414,45)$zz$ORF @ 12883-13192 CDS" |
| | | POI | 10000..12066 /product="–> IscB(6,85)[34.5] \| IscB(252,473) [106.9] \| pfam14279(337,390)[41.6] \| pfam14239(1,95)[29.7] \| COG1403(314,399)[27.6] : A(4,281007,414,7)$zz$5-methylcytosine-specific Restriction endonuclease McrA & COG1403" /label="–> IscB(6,85)[34.5] \| IscB(252,473) [106.9] \| pfam14279(337,390)[41.6] \| pfam14239(1,95)[29.7] \| COG1403(314,399)[27.6] : A(4,281007,414,7)$zz$5-methylcytosine-specific Restriction endonuclease McrA & COG1403 POI" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| | | Annotated | 10000..12066 /product="–> IscB(6,85)[34.5] | IscB(252,473) [106.9] | pfam14279(337,390)[41.6] | pfam14239(1,95)[29.7] | COG1403(314,399)[27.6] : A(4,281007,414,7)$zz$5-methylcytosine-specific Restriction endonuclease McrA & COG1403" /label="–> IscB(6,85)[34.5] | IscB(252,473) [106.9] | pfam14279(337,390)[41.6] | pfam14239(1,95)[29.7] | COG1403(314,399)[27.6] : A(4,281007,414,7)$zz$5-methylcytosine-specific Restriction endonuclease McrA & COG1403 CDS" |
| | | Questional_CDS | complement(10230..10448) /product="orf(4,281007,414,47)$zz$ORF @ 13240-13459" /label="orf(4,281007,414,47)$zz$ORF @, 13240-13459 CDS" |
| | | Questional_CDS | complement(10584..10793) /product="orf(4,281007,414,48)$zz$ORF @ 13594-13804" /label="orf(4,281007,414,48)$zz$ORF @ 13594-13804 CDS" |
| | | Questional_CDS | 10811..11239 /product="orf(4,281007,414,49)$zz$ORF @ 13821-14250" /label="orf(4,281007,414,49)$zz$ORF @ 13821-14250 CDS" |
| | | Questional_CDS | complement(11400..11804) /product="orf(4,281007,414,50)$zz$ORF @ 14410-14815" /label="orf(4,281007,414,50)$zz$ORF @ 14410-14815 CDS" |
| | | Questional_CDS | complement(11907..12644) /product="orf(4,281007,414,51)$zz$ORF @ 14917-15655" /label="orf(4,281007,414,51)$zz$ORF @ 14917-15655 CDS" |
| | | CDS | 12184..12378 /product=" A(4,281007,414,8)$zz$hypothetical protein" /label="A(4,281007,414,8)$zz$hypothetical protein CDS" |
| | | CDs | 12299..13657 /product="orf(4,281007,414,53)$zz$ORF @ 15309-16668" /label="orf(4,281007,414,53)$zz$ORF @ 15309-16668 CDS" |
| | | Annoated | complement(12428..13444) /product="–> pfam02826(121,298)[148.6] | COG0111(15,335)[206.4] : A(4,281007,414,9)$zz$phosphoglycerate dehydrogenase-like enzyme & COG0111" /label="–> pfam02826(121,298)[148.6] | COG0111(15,335)[206.4] : A(4,281007,414,9)$zz$phosphoglycerate dehydrogenase-like enzyme & COG0111 CDS" |
| | | Questional_CDS | complement(12457..12630) /product="orf(4,281007,414,55)$zz$ORF @ 15467-15641" /label="orf(4,281007,414,55)$zz$ORF @ 15467-15641 CDS" |
| | | Questional_CDS | 13462..14064 /product="orf(4,281007,414,56)$zz$ORF @ 16472-17075" /label="orf(4,281007,414,56)$zz$ORF @ 16472-17075 CDS" |
| | | Questional_CDS | 13467..13853 /product="orf(4,281007,414,57)$zz$ORF @ 16477-16864" /label="orf(4,281007,414,57)$zz$ORF @ 16477-16864 CDS" |
| | | Annotated | complement(13483..13929) /product="–> pfam03692(13,128)[31.6] : A(4,281007,414,10)$zz$putative zinc- or ironchelating protein & pfam03692" /label="–> pfam03692(13,128)[31.6] : A(4,281007,414,10)$zz$putative zinc- or ironchelating protein & pfam03692 CDS" |
| | | Questional_CDS | 13974..14168 /product="orf(4,281007,414,59)$zz$ORF @ 16984-17179" /label="orf(4,281007,414,59)$zz$ORF @ 16984-17179 CDS" |
| | | CDS | complement(14203..14382) /product="A(4,281007,414,11)$zz$hypothetical protein" /label="A(4,281007,414,11)$zz$hypothetical protein CDS" |
| | | Questional_CDS | complement(14276..14551) /product="orf(4,281007,414,61)$zz$ORF @ 17286-17562" /label="orf(4,281007,414,61)$zz$ORF @ 17286-17562 CDS" |
| | | Questional_CDS | 14502..14834 /product="orf(4,281007,414,62)$zz$ORF @ 17512-17845" /label="orf(4,281007,414,62)$zz$ORF @ 17512-17845 CDS" |

TABLE 14-continued

Geneious Features and Annotations for SEQ ID NOs: 80-92 (See also Appendix A of U.S. Provisional Application No. 62/962,672)

| SEQ ID NO: | Name | Features | Location/Qualifiers |
|---|---|---|---|
| 92 | 0315279__10036605__organized (Accession 0315279__10036605) | Padding | <1..8579 /label |
| | | CDS | 8581..9852 /product=" A(7,281630,36604,0)$zz$hypothetical protein" |
| | | CDS | complement(8581..11118) /product="orf(7,281630,36604,0)$zz$Partial ORF @ 1-2539" |
| | | CDS | 8602..9849 /product="orf(7,281630,36604,1)$zz$Partial ORF @ 22-1270" |
| | | CDS | 9072..10865 /product="orf(7,281630,36604,2)$zz$ORF @ 492-2286" |
| | | Questional_CDS | complement(9294..9695) /product="orf(7,281630,36604,3)$zz$ORF @ 714-1116" |
| | | Questional_CDS | 9696..10001) /product="orf(7,281630,36604,4)$zz$ORF @ 1116-1422" |
| | | POI | 10000..11919 /product="−> IscB(4,65)[47.6] \| IscB(205,450) [139.4] \| pfam14279(284,339)[43.2] \| pfam14239(2,73)[33.2] \| pfam14239(200,264)[30.7] \| COG1403(252,350) [43.0] : A(7,281630,36604,1)$zz$5-methylcytosine-specific restriction endonuclease McrA & COG1403" |
| | | Annotated | 10000..11919 /product="−> IscB(4,65)[47.6] \| IscB(205,450) [139.4] \| pfam14279(284,339)[43.2] \| pfam14239(2,73)[33.2] \| pfam14239(200,264)[30.7] \| COG1403(252,350) [43.0] : A(7,281630,36604,1)$zz$5-methylcytosine-specific restriction endonuclease McrA & COG1403" |
| | | Questional_CDS | complement(10266..10703) /product="orf(7,281630,36604,6)$zz$ORF @ 1686-2124 |
| | | Questional_CDS | 10962..11762 /product="orf(7,281630,36604,7)$zz$ORF @ 2382-3183" |
| | | Questional_CDS | 11258..11437 /product="orf(7,281630,36604,8)$zz$ORF @ 2678-2858" |
| | | Questional_CDS | complement(11275..11628) /product="orf(7,281630,36604,9)$zz$ORF @ 2695-3049" |
| | | Questional_CDS | complement(11704..12024) /product="orf(7,281630,36604,10)$zz$ORF @ 3124-3445" |
| | | Questional_CDS | complement(11916..12395) /product="orf(7,281630,36604,11)$zz$ORF @ 3336-3816" |
| | | DR | 12006..12033 |
| | | Questional_CDS | 12023..12403 /product="orf(7,281630,36604,12)$zz$ORF @ 3443-3824" |
| | | Questional_CDS | complement(12062..12334) /product="orf(7,281630,36604,13)$zz$ORF @ 3482-3755" |
| | | DR | 12067..12094 |
| | | Questional_CDS | complement(12109..12972) /product="orf(7,281630,36604,14)$zz$ORF @ 3529-4393" |
| | | DR | 12129..12156 |
| | | DR | 12190..12217 |
| | | DR | 12253..12280 |
| | | DR | 12316..12343 |
| | | DR | 12377..12404 |
| | | DR | 12439..12466 |
| | | DR | 12500..12527 |
| | | DR | 12562..12589 |
| | | Questional_CDS | 12579..12791 /product="orf(7,281630,36604,15)$zz$ORF @ 3999-4212" |
| | | Questional_CDS | 12797..13066 /product="orf(7,281630,36604,16)$zz$ORF @ 4217-4487" |
| | | Questional_CDS | complement(12858..13025) /product="orf(7,281630,36604,17)$zz$ORF @ 4278-4446" |
| | | Questional_CDS | complement(13046..13453) /product="orf(7,281630,36604,18)$zz$Partial ORF @ 4466-4874" |
| | | Questional_CDS | 13074..13325 /product="orf(7,281630,36604,19)$zz$ORF @ 4494-4746" |
| | | Annotated | complement(13117..13452) /product="−> pfam00291(1,100)[45.2] \| COG0031(1,109)[107.1] : A(7,281630,36604,3)$zz$cysteine synthase A & KO:K01738" |
| | | Annotated | complement(13120..13452) /product="−> pfam00291(1,100)[45.2] \| COG0031(1,109)[107.1] : orf(7,281630,36604,20)$zz$Partial ORF @ 4540-4873" |
| | | Questional_CDS | 13271..13453 /product="orf(7,281630,36604,21)$zz$Partial ORF @ 4691-4874" |

TABLE 15

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| 93 | 0214473__10157847 (Accession 0214473__10157847) | POI | 2..2635 /product="−> IscB(2,169)[28.3] \| IscB(372,447) [31.8] \| pfam13395(408,456)[29.9] : A(4,280878,157846,0)$zz$HNH endonuclease & pfam13395" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | 2..2635<br>/product="-> IscB(2,169)[28.3] \| IscB(372,447)<br>[31.8] \|<br>pfam13395(408,456)[29.9] :<br>A(4,280878,157846,0)$zz$HNH<br>endonuclease & pfam13395" |
| | | CDS | complement(2..190)<br>/product="orf(4,280878,157846,1)$zz$Partial ORF @<br>1-190" |
| | | CDS | complement(280..597)<br>/product="orf(4,280878,157846,2)$zz$ORF @<br>279-597" |
| | | CDS | complement(598..846)<br>/product="orf(4,280878,157846,3)$zz$ORF @<br>597-846" |
| | | CDS | complement(1094..1270)<br>/product="orf(4,280878,157846,4)$zz$ORF @<br>1093-1270" |
| | | CDS | complement(1361..1744)<br>/product="orf(4,280878,157846,5)$zz$ORF @<br>1360-1744" |
| | | CDS | 1404..1763<br>/product="orf(4,280878,157846,6)$zz$ORF @<br>1403-1763" |
| | | CDS | complement(1808..1981)<br>/product="orf(4,280878,157846,7)$zz$ORF @<br>1807-1981" |
| 94 | 0315274_10011761<br>(Accession<br>0315274_10011761) | CDS | complement(2..244)<br>/product="orf(7,281625,11760,0)$zz$Partial ORF @<br>1-244" |
| | | CDS | 3..806<br>/product="-> pfam00497(6,237)[163.2] \|<br>COG0834(1,247)[173.7] : orf(7,281625,11760,1)$zz$Partial<br>ORF @ 2-806" |
| | | CDS | 3..809<br>/product="-> pfam00497(6,237)[163.2] \|<br>COG0834(1,247)[173.7] :<br>A(7,281625,11760,0)$zz$glutamate/aspartate transport<br>system substrate-binding protein & KO:K10001" |
| | | CDS | complement(3..815)<br>/product="orf(7,281625,11760,2)$zz$Partial ORF @ 2-815" |
| | | CDS | complement(861..1076)<br>/product="orf(7,281625,11760,3)$zz$ORF @ 860-1076" |
| | | CDS | 971..1687<br>/product="-> pfam00528(39,232)[63.2] \|<br>COG0765(4,234)[203.8] :<br>A(7,281625,11760,1)$zz$glutamate/aspartate transport<br>system permease protein & KO:K10003" |
| | | CDS | 1027..1332<br>/product="orf(7,281625,11760,5)$zz$ORF @ 1026-1332" |
| | | CDS | complement(1385..1705)<br>/product="orf(7,281625,11760,6)$zz$ORF @ 1384-1705" |
| | | CDS | 1689..2345<br>/product="-> pfam00528(30,214)[68.8] \|<br>COG0765(1,216)[192.3] :<br>A(7,281625,11760,2)$zz$glutamate/aspartate transport<br>system permease protein & KO:K10002" |
| | | CDS | complement(2299..2481)<br>/product="orf(7,281625,11760,8)$zz$ORF @ 2298-2481" |
| | | CDS | 2342..3067<br>/product="-> pfam00005(17,165)[124.4] \|<br>COG1126(1,240)[382.5] : A(7,281625,11760,3)$zz$polar amino<br>acid transport system ATP-binding<br>protein/glutamate/aspartate transport system ATP-binding<br>protein & KO:K02028,KO:K10004" |
| | | CDS | complement(2534..3166)<br>/product="orf(7,281625,11760,10)$zz$ORF @ 2533-3166" |
| | | CDS | 2952..3815<br>/product="-> pfam01177(1,218)[171.1] \|<br>COG1794(1,224)[172.9] : orf(7,281625,11760,11)$zz$ORF @<br>2951-3815" |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | CDS | complement(3273..3443) /product="orf(7,281625,11760,12)$zz$ORF @ 3272-3443" |
| | CDS | 3436..3717 /product="orf(7,281625,11760,13)$zz$ORF @ 3435-3717" |
| | CDS | complement(4003..4980) /product="orf(7,281625,11760,14)$zz$ORF @ 4002-4980" |
| | CDS | 4033..5037 /product="−> pfam00291(9,318)[180.3] \| COG2515(1,330)[348.7] : A(7,281625,11760,5)$zz$D-cysteine desulfhydrase & KO:K05396" |
| | CDS | 4625..4843 /product="orf(7,281625,11760,16)$zz$ORF @ 4624-4843" |
| | CDS | complement(5051..5368) /product="orf(7,281625,11760,17)$zz$ORF @ 5050-5368" |
| | CDS | 5278..5481 /product="orf(7,281625,11760,18)$zz$ORF @ 5277-5481" |
| | CDS | 5743..8607 /product="−> IscB(3,171)[30.9] \| IscB(374,449)[32.0] \| pfam14239(1,179)[28.0] \| pfam13395(410,458)[25.9] : A(7,281625,11760,6)$zz$RRXRR protein/HNH endonuclease & pfam14239,pfam13395" |
| | CDS | 5743..8607 /product="−> IscB(3,171)[30.9] \| IscB(374,449)[32.0] \| pfam14239(1,179)[28.0] \| pfam13395(410,458)[25.9] : A(7,281625,11760,6)$zz$RRXRR protein/HNH endonuclease & pfam14239,pfam13395" |
| | CDS | complement(6241..6447) /product="orf(7,281625,11760,20)$zz$ORF @ 6240-6447" |
| | CDS | complement(6535..7017) /product="orf(7,281625,11760,21)$zz$ORF @ 6534-7017" |
| | CDS | complement(6872..7078) /product="orf(7,281625,11760,22)$zz$ORF @ 6871-7078" |
| | CDS | 7166..7510 /product="orf(7,281625,11760,23)$zz$ORF @ 7165-7510" |
| | CDS | complement(7555..7902) /product="orf(7,281625,11760,24)$zz$ORF @ 7554-7902" |
| | CDS | complement(7914..8108) /product="orf(7,281625,11760,25)$zz$ORF @ 7913-8108" |
| | DR | 8807..8843 |
| | DR | 8880..8916 |
| | CDS | 8937..9110 /product="orf(7,281625,11760,26)$zz$ORF @ 8936-9110" |
| | DR | 8952..8988 |
| | DR | 9024..9060 |
| | DR | 9095..9131 |
| | DR | 9166..9202 |
| | DR | 9238..9274 |
| | DR | 9309..9345 |
| | DR | 9380..9416 |
| | CDS | complement(9785..9952) /product="orf(7,281625,11760,27)$zz$ORF @ 9784-9952" |
| | CDS | 9837..10400 /product="A(7,281625,11760,7)$zz$hypothetical protein" |
| | CDS | complement(10092..10289) /product="orf(7,281625,11760,29)$zz$ORF @ 10091-10289" |
| | CDS | complement(10576..10896) /product="orf(7,281625,11760,30)$zz$ORF @ 10575-10896" |
| | CDS | 10595..11545 /product="−> pfam02540(146,310)[125.4] \| pfam02540(21,115)[86.9] \| COG0171(14,315)[208.5] : A(7,281625,11760,8)$zz$NAD+ synthase & KO:K01916" |
| | CDS | 11523..11660 /product="A(7,281625,11760,9)$zz$hypothetical protein" |
| | CDS | 11732..12112 /product="A(7,281625,11760,10)$zz$hypothetical protein" |
| | CDS | complement(12231..12530) /product="orf(7,281625,11760,33)$zz$Partial ORF @ 12230-12530" |
| | CDS | 12456..12530 /product="A(7,281625,11760,11)$zz$hypothetical protein" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| 95 | 0181520__10000764 (Accession 0181520__10000764) | CDS | 461..772<br>/product="orf(18,33974,763,103)$zz$ORF @ 32160-32472" |
| | | CDS | 663..1013<br>/product="orf(18,33974,763,104)$zz$ORF @ 32362-32713" |
| | | CDS | complement(704..898)<br>/product="orf(18,33974,763,105)$zz$ORF @ 32403-32598" |
| | | CDS | complement(723..2675)<br>/product="–> pfam13414(489,529)[38.0] \| pfam13424(411,479)[37.9] \| pfam13231(68,230)[26.1] \| pfam07719(515,548)[23.8] \| pfam07721(591,614)[13.3] \| COG0457(308,561)[74.7] :<br>A(18,33974,763,13)$zz$Tetratricopeptide (TPR) repeat & COG0457" |
| | | CDS | 881..1063<br>/product="orf(18,33974,763,107)$zz$ORF @ 32580-32763" |
| | | CDS | 1065..1670<br>/product="orf(18,33974,763,108)$zz$ORF @ 32764-33370" |
| | | CDS | complement(1070..1237)<br>/product="orf(18,33974,763,109)$zz$ORF @ 32769-32937" |
| | | CDS | complement(1324..2061)<br>/product="orf(18,33974,763,110)$zz$ORF @ 33023-33761" |
| | | CDS | 2292..2837<br>/product="orf(18,33974,763,111)$zz$ORF @ 33991-34537" |
| | | CDS | 2665..2916<br>/product="orf(18,33974,763,112)$zz$ORF @ 34364-34616" |
| | | CDS | complement(2704..2880)<br>/product="orf(18,33974,763,113)$zz$ORF @ 34403-34580" |
| | | CDS | complement(2934..3089)<br>/product="A(18,33974,763,14)$zz$hypothetical protein & Hypo-rule applied" |
| | | CDS | 3054..3293<br>/product="orf(18,33974,763,114)$zz$ORF @ 34753-34993" |
| | | CDS | 3089..3733<br>/product="orf(18,33974,763,115)$zz$ORF @ 34788-35433" |
| | | CDS | complement(3439..3606)<br>/product="orf(18,33974,763,116)$zz$ORF @ 35138-35306" |
| | | CDS | complement(3610..3867)<br>/product="orf(18,33974,763,117)$zz$ORF @ 35309-35567" |
| | | CDS | complement(3915..4616)<br>/product="orf(18,33974,763,118)$zz$ORF @ 35614-36316" |
| | | CDS | 3918..4724<br>/product="–> pfam00977(5,238)[291.2] \| COG0107(1,256)[377.5] : A(18,33974,763,16)$zz$cyclase & KO:K02500" |
| | | CDS | 3949..4134<br>/product="orf(18,33974,763,120)$zz$ORF @ 35648-35834" |
| | | CDS | complement(4082..4354)<br>/product="orf(18,33974,763,121)$zz$ORF @ 35781-36054" |
| | | CDS | complement(4486..4728)<br>/product="orf(18,33974,763,122)$zz$ORF @ 36185-36428" |
| | | CDS | complement(4721..5740)<br>/product="orf(18,33974,763,123)$zz$ORF @ 36420-37440" |
| | | CDS | 4727..5878<br>/product="–> pfam00437(25,293)[122.2] \| COG2805(16,374)[383.3] : A(18,33974,763,17)$zz$twitching motility protein PilT & KO:K02669" |
| | | CDS | complement(4750..5100)<br>/product="orf(18,33974,763,125)$zz$ORF @ 36449-36800" |
| | | CDS | complement(5242..5436)<br>/product="orf(18,33974,763,126)$zz$ORF @ 36941-37136" |
| | | CDS | complement(5437..7071)<br>/product="orf(18,33974,763,127)$zz$ORF @ 37136-38771" |
| | | CDS | 5911..7731<br>/product="–> pfam00437(219,490)[49.3] \| COG2804(131,606)[171.5] : A(18,33974,763,18)$zz$Type II secretory pathway ATPase GspE/PulE or T4P pilus assembly pathway ATPase PilB & COG2804" |
| | | CDS | 6396..7748<br>/product="orf(18,33974,763,129)$zz$ORF @ 38095-39448" |
| | | CDS | complement(6428..6601)<br>/product="orf(18,33974,763,130)$zz$ORF @ 38127-38301" |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | CDS | 6803..7252<br>/product="orf(18,33974,763,131)$zz$ORF @ 38502-38952" |
| | CDS | complement(7107..7439)<br>/product="orf(18,33974,763,132)$zz$ORF @ 38806-39139" |
| | CDS | complement(7129..8364)<br>/product="orf(18,33974,763,133)$zz$ORF @ 38828-40064" |
| | CDS | 7385..7648<br>/product="orf(18,33974,763,134)$zz$ORF @ 39084-39348" |
| | CDS | complement(7691..8356)<br>/product="orf(18,33974,763,135)$zz$ORF @ 39390-40056" |
| | CDS | 7745..8383<br>/product="–> pfam02674(5,139)[48.8] :<br>A(18,33974,763,19)$zz$Colicin V production protein &<br>pfam02674" |
| | CDS | 8407..9141<br>/product="A(18,33974,763,20)$zz$hypothetical protein &<br>Hypo-rule applied" |
| | CDS | 9528..9713<br>/product="orf(18,33974,763,138)$zz$ORF @ 41227-41413" |
| | DR | 9562..9589 |
| | DR | 9627..9663 |
| | DR | 9698..9734 |
| | DR | 9771..9807 |
| | CDS | complement(9817..10041)<br>/product="orf(18,33974,763,139)$zz$ORF @ 41516-41741" |
| | POI | 10001..12142<br>/product="–> IscB(2,161)[27.4] | IscB(350,451)[40.1] |<br>pfam14239(1,167)[26.3] | pfam13395(407,452)[26.1] :<br>A(18,33974,763,21)$zz$RRXRR protein/HNH endonuclease &<br>pfam14239,pfam13395" |
| | CDS | 10001..12142<br>/product="–> IscB(2,161)[27.4] | IscB(350,451)[40.1] |<br>pfam14239(1,167)[26.3] | pfam13395(407,452)[26.1] :<br>A(18,33974,763,21)$zz$RRXRR protein/HNH endonuclease &<br>pfam14239,pfam13395" |
| | CDS | 10062..10424<br>/product="orf(18,33974,763,141)$zz$ORF @ 41761-42124" |
| | CDS | complement(10125..10655)<br>/product="orf(18,33974,763,142)$zz$ORF @ 41824-42355" |
| | CDS | complement(10421..11431)<br>/product="orf(18,33974,763,143)$zz$ORF @ 42120-43131" |
| | CDS | 10425..10793<br>/product="orf(18,33974,763,144)$zz$ORF @ 42124-42493" |
| | CDS | 11166..11369<br>/product="orf(18,33974,763,145)$zz$ORF @ 42865-43069" |
| | CDS | complement(11600..12229)<br>/product="orf(18,33974,763,146)$zz$ORF @ 43299-43929" |
| | CDS | complement(12079..12246)<br>/product="orf(18,33974,763,147)$zz$ORF @ 43778-43946" |
| | CDS | 12170..12964<br>/product="orf(18,33974,763,148)$zz$ORF @ 43869-44664" |
| | CDS | complement(13034..15979)<br>/product="–> pfam00176(348,606)[120.4] |<br>pfam00271(623,736)[80.6] | COG0553(282,793)[321.9] :<br>orf(18,33974,763,149)$zz$ORF @ 44733-47679" |
| | CDS | complement(13162..13344)<br>/product="orf(18,33974,763,150)$zz$ORF @ 44861-45044" |
| | CDS | 13557..13901<br>/product="orf(18,33974,763,151)$zz$ORF @ 45256-45601" |
| | CDS | 13562..14248<br>/product="orf(18,33974,763,152)$zz$ORF @ 45261-45948" |
| | CDS | 13944..14168<br>/product="orf(18,33974,763,153)$zz$ORF @ 45643-45868" |
| | CDS | complement(14014..14289)<br>/product="orf(18,33974,763,154)$zz$ORF @ 45713-45989" |
| | CDS | 14534..15694<br>/product="orf(18,33974,763,155)$zz$ORF @ 46233-47394" |
| | CDS | 14826..15035<br>/product="orf(18,33974,763,156)$zz$ORF @ 46525-46735" |
| | CDS | complement(14854..15120)<br>/product="orf(18,33974,763,157)$zz$ORF @ 46553-46820" |
| | CDS | complement(14868..15785)<br>/product="orf(18,33974,763,158)$zz$ORF @ 46567-47485" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | 15803..15976<br>/product="orf(18,33974,763,159)$zz$ORF @ 47502-47676" |
| | | CDS | 15834..16007<br>/product="orf(18,33974,763,160)$zz$ORF @ 47533-47707" |
| | | CDS | complement(15924..16202)<br>/product="orf(18,33974,763,161)$zz$ORF @ 47623-47902" |
| | | CDS | complement(16021..17568)<br>/product="orf(18,33974,763,162)$zz$ORF @ 47720-49268" |
| | | CDS | 16120..17601<br>/product="-> pfam13184(199,267)[90.1] \|<br>pfam08529(5,63)[45.5] \| pfam08529(59,94)[23.7] \|<br>COG0195(126,323)[230.4] : A(18,33974,763,24)$zz$N<br>utilization substance protein A & KO:K02600" |
| | | CDS | complement(16263..16454)<br>/product="orf(18,33974,763,164)$zz$ORF @ 47962-48154" |
| | | CDS | complement(16461..16703)<br>/product="orf(18,33974,763,165)$zz$ORF @ 48160-48403" |
| | | CDS | 17585..17911<br>/product="orf(18,33974,763,166)$zz$ORF @ 49284-49611" |
| | | CDS | 17667..20429<br>/product="-> pfam00009(417,580)[122.8] \|<br>pfam11987(704,810)[111.4] \| pfam03144(841,909)[35.8] \|<br>COG0532(414,920)[481.4] :<br>A(18,33974,763,25)$zz$translation initiation factor IF-2 &<br>KO:K02519" |
| | | CDS | complement(17688..17867)<br>/product="orf(18,33974,763,167)$zz$ORF @ 49387-49567" |
| | | CDS | complement(17915..18358)<br>/product="orf(18,33974,763,169)$zz$ORF @ 49614-50058" |
| | | CDS | complement(17985..18620)<br>/product="orf(18,33974,763,170)$zz$ORF @ 49684-50320" |
| | | CDS | 18343..18534<br>/product="orf(18,33974,763,171)$zz$ORF @ 50042-50234" |
| | | CDS | complement(18386..18988)<br>/product="orf(18,33974,763, 172)$zz$ORF @ 50085-50688" |
| | | CDS | 18577..18930<br>/product="orf(18,33974,763,173)$zz$ORF @ 50276-50630" |
| | | CDS | complement(18804..20402)<br>/product="orf(18,33974,763,174)$zz$ORF @ 50503-52102" |
| | | CDS | complement(19037..19225)<br>/product="orf(18,33974,763, 175)$zz$ORF @ 50736-50925" |
| | | CDS | complement(19277..19489)<br>/product="orf(18,33974,763,176)$zz$ORF @ 50976-51189" |
| | | CDS | 19316..19804<br>/product="orf(18,33974,763,177)$zz$ORF @ 51015-51504" |
| | | CDS | complement(20072..20242)<br>/product="orf(18,33974,763,178)$zz$ORF @ 51771-51942" |
| | | CDS | 20476..20895<br>/product="-> pfam02033(5,108)[87.2] \|<br>COG0858(1,116)[95.5]:<br>A(18,33974,763,26)$zz$ribosome-binding factor A<br>&KO:K02834" |
| | | CDS | complement(20877..21326)<br>/product="orf(18,33974,763,180)$zz$ORF @ 52576-53026" |
| | | CDS | 20892..21875<br>/product="-> COG0177(5,222)[25.0] :<br>A(18,33974,763,27)$zz$endonuclease-3 & KO:K10773" |
| 96 | 0212124_10005596<br>(Accession<br>0212124_10005596) | CDS | complement(65..460)<br>/product="orf(37,241602,5456,0)$zz$ORF @ 64-460" |
| | | CDS | 104..1741<br>/product="orf(37,241602,5456,1)$zz$ORF @ 103-1741" |
| | | CDS | complement(217..441)<br>/product="orf(37,241602,5456,2)$zz$ORF @ 216-441" |
| | | CDS | complement(1001..1477)<br>/product="orf(37,241602,5456,3)$zz$ORF @ 1000-1477" |
| | | CDS | 1963..2205<br>/product="orf(37,241602,5456,4)$zz$ORF @ 1962-2205" |
| | | CDS | complement(2269..2451)<br>/product="orf(37,241602,5456,5)$zz$ORF @ 2268-2451" |
| | | CDS | complement(2315..2503)<br>/product="orf(37,241602,5456,6)$zz$ORF @ 2314-2503" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | 2588..5431<br>/product="–> IscB(1,73)[26.6] \| IscB(350,447)[39.5] : orf(37,241602,5456,7)$zz$ORF @ 2587-5431" |
| | | CDS | 2588..5431<br>/product="–> IscB(1,73)[26.6] \| IscB(350,447)[39.5] : orf(37,241602,5456,7)$zz$ORF @ 2587-5431" |
| | | CDS | complement(2608..2841)<br>/product="orf(37,241602,5456,8)$zz$ORF @ 2607-2841" |
| | | CDS | complement(2693..2908)<br>/product="orf(37,241602,5456,9)$zz$ORF @ 2692-2908" |
| | | CDS | complement(3218..4324)<br>/product="orf(37,241602,5456,10)$zz$ORF @ 3217-4324" |
| | | CDS | 3579..3782<br>/product="orf(37,241602,5456,11)$zz$ORF @ 3578-3782" |
| | | CDS | complement(4317..4793)<br>/product="orf(37,241602,5456,12)$zz$ORF @ 4316-4793" |
| | | CDS | complement(5120..5449)<br>/product="orf(37,241602,5456,13)$zz$ORF @ 5119-5449" |
| | | DR | 5646..5672 |
| | | DR | 5710..5744 |
| | | DR | 5781..5816 |
| | | DR | 5852..5887 |
| | | DR | 5922..5957 |
| | | DR | 5992..6027 |
| | | DR | 6063..6098 |
| | | DR | 6134..6169 |
| | | CDS | complement(6608..6982)<br>/product="orf(37,241602,5456,14)$zz$ORF @ 6607-6982" |
| | | CDS | complement(6655..6930)<br>/product="orf(37,241602,5456,15)$zz$ORF @ 6654-6930" |
| | | CDS | 6929..7330<br>/product="orf(37,241602,5456,16)$zz$ORF @ 6928-7330" |
| | | CDS | complement(7022..7852)<br>/product="orf(37,241602,5456,17)$zz$ORF @ 7021-7852" |
| | | CDS | complement(7123..7293)<br>/product="orf(37,241602,5456,18)$zz$ORF @ 7122-7293" |
| | | CDS | 7370..8041<br>/product="orf(37,241602,5456,19)$zz$ORF @ 7369-8041" |
| | | CDS | 7464..7808<br>/product="orf(37,241602,5456,20)$zz$ORF @ 7463-7808" |
| | | CDS | 8689..8856<br>/product="orf(37,241602,5456,22)$zz$ORF @ 8688-8856" |
| 97 | 0315279__10007213 (Accession 0315279__10007213 | CDS | 16..162<br>/product="A(7,281630,7212,0)$zz$hypothetical protein" |
| | | POI | 166..2967<br>/product="–> IscB(338,439)[53.7] \| cas9(388,458)[31.0] \| KOON_cd09643(386,573)[29.2] \| TIGR01865(356,573)[30.4] \| pfam13395(394,441)[38.7] \| COG1403(351,464)[26.5] : A(7,281630,7212,1)$zz$5-methylcytosine-specific restriction endonuclease McrA & COG1403" |
| | | CDS | 166..2967<br>/product="–> IscB(338,439)[53.7] \| cas9(388,458)[31.0] \| KOON_cd09643(386,573)[29.2] \| TIGR01865(356,573)[30.4] \| pfam13395(394,441)[38.7] \| COG1403(351,464)[26.5] : A(7,281630,7212,1)$zz$5-methylcytosine-specific restriction endonuclease McrA & COG1403" |
| | | CDS | complement(186..359)<br>/product="orf(7,281630,7212,1)$zz$ORF @ 185-359" |
| | | CDS | 729..938<br>/product="orf(7,281630,7212,2)$zz$ORF @ 728-938" |
| | | CDS | complement(1312..1581)<br>/product="orf(7,281630,7212,3)$zz$ORF @ 1311-1581" |
| | | CDS | complement(2305..2766)<br>/product="orf(7,281630,7212,4)$zz$ORF @ 2304-2766" |
| | | DR | 3180..3215 |
| | | DR | 3251..3286 |
| | | DR | 3321..3356 |
| | | DR | 3391..3426 |
| | | DR | 3463..3498 |
| | | CDS | 3743..3988<br>/product="A(7,281630,7212,2)$zz$hypothetical protein" |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | CDS | complement(4039..4269)<br>/product="orf(7,281630,7212,6)$zz$ORF @ 4038-4269" |
| | CDS | 4077..4319<br>/product="–> pfam01402(6,44)[23.6] \| COG0864(1,71)[39.4] :A(7,281630,7212,3)$zz$metal-responsive CopG/Arc/MetJ familytranscriptional regulator & COG0864" |
| | CDS | 4388..4639<br>/product="–> pfam02452(1,82)[57.3] \| COG2337(1,82)[43.6] :A(7,281630,7212,4)$zz$mRNA interferase MazF & KO:K07171" |
| | CDS | 4678..5475<br>/product="A(7,281630,7212,5)$zz$hypothetical protein" |
| | CDS | complement(5428..5604)<br>/product="orf(7,281630,7212,9)$zz$ORF @ 5427-5604" |
| | CDS | 5486..6493<br>/product="–> pfam01136(86,329)[107.8] \| COG0826(1,327)[100.4] : A(7,281630,7212,6)$zz$putative protease & KO:K08303" |
| | CDS | complement(5531..5722)<br>/product="orf(7,281630,7212,11)$zz$ORF @ 5530-5722" |
| | CDS | complement(5924..6121)<br>/product="orf(7,281630,7212,12)$zz$ORF @ 5923-6121" |
| | CDS | 6033..6227<br>/product="orf(7,281630,7212,13)$zz$ORF @ 6032-6227" |
| | CDS | complement(6118..6387)<br>/product="orf(7,281630,7212,14)$zz$ORF @ 6117-6387" |
| | CDS | 6612..7814<br>/product="–> pfam09825(15,117)[28.4] \| COG4285(11,263)[38.5] : A(7,281630,7212,7)$zz$glutamine amidotransferase-like uncharacterized protein & COG4285" |
| | CDS | complement(6677..6856)<br>/product="orf(7,281630,7212,16)$zz$ORF @ 6676-6856" |
| | CDS | 7222..7449<br>/product="orf(7,281630,7212,17)$zz$ORF @ 7221-7449" |
| | CDS | 7828..8616<br>/product="–> pfam02665(57,256)[43.3] \| COG2181(9,251)[48.2] : A(7,281630,7212,8)$zz$nitrate reductase gamma subunit & COG2181" |
| | CDS | complement(8506..8715)<br>/product="orf(7,281630,7212,19)$zz$ORF @ 8505-8715" |
| | CDS | 8573..9928<br>/product="–> pfam02754(334,422)[74.1] \| pfam02754(210,295)[47.4] \| pfam13183(49,138)[40.7] \| COG0247(43,449)[333.8] : A(7,281630,7212,9)$zz$heterodisulfide reductase subunit D & KO:K08264" |
| | CDS | 8724..8900<br>/product="orf(7,281630,7212,21)$zz$ORF @ 8723-8900" |
| | CDS | complement(9428..9595)<br>/product="orf(7,281630,7212,22)$zz$ORF @ 9427-9595" |
| | CDS | 10091..11116<br>/product="–> pfam13379(38,273)[125.1] \| COG0715(14,331)[217.8] : A(7,281630,7212,10)$zz$NitT/TauT family transport system substrate-binding protein & KO:K02051" |
| | CDS | complement(10417..10623)<br>/product="orf(7,281630,7212,24)$zz$ORF @ 10416-10623" |
| | CDS | complement(10699..10896)<br>/product="orf(7,281630,7212,25)$zz$ORF @ 10698-10896" |
| | CDS | 11244..11858<br>/product="–> pfam00528(29,200)[85.8] \| COG0600(1,204)[242.0] : A(7,281630,7212,11)$zz$NitT/TauT family transport system permease protein & KO:K02050" |
| | CDS | complement(11288..11632)<br>/product="orf(7,281630,7212,27)$zz$ORF @ 11287-11632" |
| | CDS | complement(11634..11909)<br>/product="orf(7,281630,7212,28)$zz$ORF @ 11633-11909" |
| | CDS | 11876..12631<br>/product="–> pfam00005(24,164)[121.1] \| COG1116(2,251)[301.2] : A(7,281630,7212,12)$zz$NitT/TauT family transport system ATP-binding protein & KO:K02049" |
| | CDS | complement(11893..12075)<br>/product="orf(7,281630,7212,30)$zz$ORF @ 11892-12075" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | complement(12670..12861)<br>/product="orf(7,281630,7212,32)$zz$ORF @ 12669-12861" |
| 98 | 0315296_10021693<br>(Accession<br>0315296_10021693) | CDS | 26..238<br>/product="orf(7,281647,21692,0)$zz$Partial ORF @ 25-238" |
| | | POI | 402..3263<br>/product="–> IscB(3,68)[29.8] \| IscB(373,454)[40.9] \|<br>pfam14239(1,136)[27.4] \| pfam13395(409,457)[26.7] :<br>A(7,281647,21692,0)$zz$RRXRR protein/HNH endonuclease &<br>pfam14239,pfam13395" |
| | | CDS | 402..3263<br>/product="–> IscB(3,68)[29.8] \| IscB(373,454)[40.9] \|<br>pfam14239(1,136)[27.4] \| pfam13395(409,457)[26.7] :<br>A(7,281647,21692,0)$zz$RRXRR protein/HNH endonuclease &<br>pfam14239,pfam13395" |
| | | CDS | complement(653..1000)<br>/product="orf(7,281647,21692,2)$zz$ORF @ 652-1000" |
| | | CDS | complement(1410..1673)<br>/product="orf(7,281647,21692,3)$zz$ORF @ 1409-1673" |
| | | DR | 3485..3511 |
| | | DR | 3555..3581 |
| | | CDS | complement(3686..4063)<br>/product="orf(7,281647,21692,4)$zz$ORF @ 3685-4063" |
| | | CDS | complement(3790..4107)<br>/product="orf(7,281647,21692,5)$zz$ORF @ 3789-4107" |
| | | CDS | 3809..3946<br>/product="A(7,281647,21692,1)$zz$hypothetical protein" |
| | | CDS | 4019..4375<br>/product="A(7,281647,21692,2)$zz$hypothetical protein" |
| | | CDS | complement(4332..4505)<br>/product="A(7,281647,21692,3)$zz$hypothetical protein" |
| 99 | a0209605_1001101<br>(Accession<br>a0209605_1001101) | CDS | 1..198<br>/product="orf(11,21340,1100,0)$zz$Partial ORF @ 0-198" |
| | | CDS | 2..307<br>/product="orf(11,21340,1100,1)$zz$Partial ORF @ 1-307" |
| | | CDS | complement(2..436)<br>/product="A(11,21340,1100,0)$zz$transposase & KO:K07488" |
| | | CDS | 268..549<br>/product="orf(11,21340,1100,3)$zz$ORF @ 267-549" |
| | | CDS | 724..2109<br>/product="A(11,21340,1100,1)$zz$transcriptional regulator<br>with PAS, ATPase and Fis domain & COG3829" |
| | | CDS | complement(730..915)<br>/product="orf(11,21340,1100,5)$zz$ORF @ 729-915" |
| | | CDS | complement(1119..1367)<br>/product="orf(11,21340,1100,6)$zz$ORF @ 1118-1367" |
| | | CDS | complement(2323..3555)<br>/product="A(11,21340,1100,2)$zz$CoA:oxalate<br>CoA-transferase & KO:K18702" |
| | | CDS | 3155..3337<br>/product="orf(11,21340,1100,8)$zz$ORF @ 3154-3337" |
| | | CDS | 3334..3585<br>/product="orf(11,21340,1100,9)$zz$ORF @ 3333-3585" |
| | | CDS | complement(4060..4176)<br>/product="A(11,21340,1100,3)$zz$hypothetical protein" |
| | | CDS | 4381..5202<br>/product="A(11,21340,1100,4)$zz$enoyl-CoA hydratase &<br>KO:K01692" |
| | | CDS | complement(4725..5033)<br>/product="orf(11,21340,1100,11)$zz$ORF @ 4724-5033" |
| | | CDS | 5228..5365<br>/product="A(11,21340,1100,5)$zz$hypothetical protein" |
| | | CDS | 5410..6996<br>/product="A(11,21340,1100,6)$zz$sodium/proline symporter<br>&KO:K11928" |
| | | CDS | 5568..5753<br>/product="orf(11,21340,1100,13)$zz$ORF @ 5567-5753" |
| | | CDS | complement(5706..5873)<br>/product="orf(11,21340,1100,14)$zz$ORF @ 5705-5873" |
| | | CDS | complement(5886..6155)<br>/product="orf(11,21340,1100,15)$zz$ORF @ 5885-6155" |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | CDS | complement(6240..6470)<br>/product="orf(11,21340,1100,16)$zz$ORF @ 6239-6470" |
| | CDS | complement(6985..7173)<br>/product="orf(11,21340,1100,17)$zz$ORF @ 6984-7173" |
| | CDS | 7188..7382<br>/product="orf(11,21340,1100,18)$zz$ORF @ 7187-7382" |
| | CDS | complement(7646..8017)<br>/product="orf(11,21340,1100,19)$zz$ORF @ 7645-8017" |
| | CDS | 7692..8381<br>/product="A(11,21340,1100,7)$zz$integrase/recombinase XerD& KO:K04763" |
| | CDS | complement(8304..8609)<br>/product="orf(11,21340,1100,21)$zz$ORF @ 8303-8609" |
| | CDS | 8397..8624<br>/product="A(11,21340,1100,8)$zz$hypothetical protein" |
| | CDS | 8636..8884<br>/product="A(11,21340,1100,9)$zz$hypothetical protein" |
| | POI | 9364..12198<br>/product="–> IscB(1,66)[30.5] | IscB(349,453)[39.7] : A(11,21340,1100,10)$zz$RRXRR protein/HNH endonuclease & pfam14239,pfam13395" |
| | CDS | 9364..12198<br>/product="–> IscB(1,66)[30.5] | IscB(349,453)[39.7] : A(11,21340,1100,10)$zz$RRXRR protein/HNH endonuclease & pfam14239,pfam13395" |
| | CDS | complement(9995..10180)<br>/product="orf(11,21340,1100,25)$zz$ORF @ 9994-10180" |
| | CDS | complement(10078..10254)<br>/product="orf(11,21340,1100,26)$zz$ORF @ 10077-10254" |
| | CDS | 10478..10702<br>/product="orf(11,21340,1100,27)$zz$ORF @ 10477-10702" |
| | CDS | complement(11221..11481)<br>/product="orf(11,21340,1100,28)$zz$ORF @ 11220-11481" |
| | CDS | complement(11608..11838)<br>/product="orf(11,21340,1100,29)$zz$ORF @ 11607-11838" |
| | CDS | complement(12037..12219)<br>/product="orf(11,21340,1100,30)$zz$ORF @ 12036-12219" |
| | DR | 12397..12432 |
| | DR | 12467..12502 |
| | DR | 12562..12597 |
| | DR | 12632..12667 |
| | DR | 12701..12736 |
| | DR | 12771..12806 |
| | DR | 12842..12877 |
| | DR | 12912..12947 |
| | CDS | complement(12919..13104)<br>/product="orf(11,21340,1100,31)$zz$ORF @ 12918-13104" |
| | CDS | complement(13688..14137)<br>/product="orf(11,21340,1100,32)$zz$ORF @ 13687-14137" |
| | CDS | 13703..14719<br>/product="A(11,21340,1100,11)$zz$glyceraldehyde 3-phosphate dehydrogenase & KO:K00134" |
| | CDS | complement(13852..14100)<br>/product="orf(11,21340,1100,34)$zz$ORF @ 13851-14100" |
| | CDS | complement(14572..14808)<br>/product="orf(11,21340,1100,35)$zz$ORF @ 14571-14808" |
| | CDS | 14720..15478<br>/product="A(11,21340,1100,12)$zz$triosephosphate isomerase& KO:K01803" |
| | CDS | complement(14819..15019)<br>/product="orf(11,21340,1100,37)$zz$ORF @ 14818-15019" |
| | CDS | complement(15310..15963)<br>/product="orf(11,21340,1100,38)$zz$ORF @ 15309-15963" |
| | CDS | 15499..15885<br>/product="A(11,21340,1100,13)$zz$preprotein translocase subunit SecG & KO:K03075" |
| | CDS | complement(15831..16052)<br>/product="orf(11,21340,1100,40)$zz$ORF @ 15830-16052" |
| | CDS | complement(15956..16144)<br>/product="orf(11,21340,1100,41)$zz$ORF @ 15955-16144" |
| | CDS | complement(16277..16459)<br>/product="orf(11,21340,1100,42)$zz$ORF @ 16276-16459" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | complement(16297..16494) /product="A(11,21340,1100,14)$zz$hypothetical protein" |
| | | CDS | 16399..16605 /product="orf(11,21340,1100,44)$zz$ORF @ 16398-16605" |
| | | CDS | 16406..16585 /product="orf(11,21340,1100,45)$zz$ORF @ 16405-16585" |
| | | CDS | complement(16500..17594) /product="A(11,21340,1100,15)$zz$3-deoxy-D-manno-octuloson i c-acid transferase/heptosyltransferase-1 & KO:K02527,KO:K02841" |
| | | CDS | 16621..16821 /product="orf(11,21340,1100,47)$zz$ORF @ 16620-16821" |
| | | CDS | 16773..17270 /product="orf(11,21340,1100,48)$zz$ORF @ 16772-17270" |
| | | CDS | complement(17356..17718) /product="orf(11,21340,1100,49)$zz$ORF @ 17355-17718" |
| | | CDS | 17451..17648 /product="orf(11,21340,1100,50)$zz$ORF @ 17450-17648" |
| | | CDS | complement(17591..18151) /product="A(11,21340,1100,16)$zz$D-glycero-D-manno-heptose 1,7-bisphosphate phosphatase & KO:K03273" |
| | | CDS | 17717..18160 /product="orf(11,21340,1100,52)$zz$ORF @ 17716-18160" |
| | | CDS | complement(18148..19227) /product="A(11,21340,1100,17)$zz$heptosyltransferase-2 & KO:K02843" |
| | | CDS | 18169..19242 /product="orf(11,21340,1100,54)$zz$ORF @ 18168-19242" |
| | | CDS | 18224..18622 /product="orf(11,21340,1100,55)$zz$ORF @ 18223-18622" |
| | | CDS | complement(18743..18976) /product="orf(11,21340,1100,56)$zz$ORF @ 18742-18976" |
| | | CDS | complement(18831..19013) /product="orf(11,21340,1100,57)$zz$ORF @ 18830-19013" |
| | | CDS | 19019..19234 /product="orf(11,21340,1100,58)$zz$ORF @ 19018-19234" |
| | | CDS | complement(19221..20105) /product="A(11,21340,1100,18)$zz$KDO2-lipid IV(A) lauroyltransferase & KO:K02517" |
| | | CDS | 19290..20057 /product="orf(11,21340,1100,60)$zz$ORF @ 19289-20057" |
| | | CDS | 19429..19692 /product="orf(11,21340,1100,61)$zz$ORF @ 19428-19692" |
| | | CDS | complement(20102..21208) /product="A(11,21340,1100,19)$zz$tetraacyldisaccharide 4'-kinase & KO:K00912" |
| | | CDS | 20312..20497 /product="orf(11,21340,1100,63)$zz$ORF @ 20311-20497" |
| | | CDS | 20463..20909 /product="orf(11,21340,1100,64)$zz$ORF @ 20462-20909" |
| | | CDS | 20630..21412 /product="orf(11,21340,1100,65)$zz$ORF @ 20629-21412" |
| | | CDS | 21177..21767 /product="orf(11,21340,1100,66)$zz$ORF @ 21176-21767" |
| | | CDS | 21346..21633 /product="orf(11,21340,1100,68)$zz$ORF @ 21345-21633" |
| | | CDS | 21661..21834 /product="orf(11,21340,1100,69)$zz$ORF @ 21660-21834" |
| | | CDS | 21844..22128 /product="orf(11,21340,1100,70)$zz$ORF @ 21843-22128" |
| 100 | a0209605_1001101 (Accessiona0209605_1001101) | CDS | 1..198 /product="orf(11,21340,1100,0)$zz$Partial ORF @ 0-198" |
| | | CDS | 2..307 /product="orf(11,21340,1100,1)$zz$Partial ORF @ 1-307" |
| | | CDS | complement(2..436) /product="–> pfam12760(11,56)[36.3] : A(11,21340,1100,0)$zz$transposase & KO:K07488" |
| | | CDS | 268..549 /product="orf(11,21340,1100,3)$zz$ORF @ 267-549" |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
| --- | --- | --- |
| | CDS | 724..2109<br>/product="-> pfam00158(150,318)[213.1] \| pfam08448(14,118)[27.9] \| COG3829(1,456)[452.1] : A(11,21340,1100,1)$zz$transcriptional regulator with PAS, ATPase and Fis domain & COG3829" |
| | CDS | complement(730..915)<br>/product="orf(11,21340,1100,5)$zz$ORF @ 729-915" |
| | CDS | complement(1119..1367)<br>/product="orf(11,21340,1100,6)$zz$ORF @ 1118-1367" |
| | CDS | complement(2323..3555)<br>/product="-> pfam02515(20,387)[446.8] \| COG1804(10,410)[464.6] : A(11,21340,1100,2)$zz$CoA:oxalate CoA-transferase & KO:K18702" |
| | CDS | 3155..3337<br>/product="orf(11,21340,1100,8)$zz$ORF @ 3154-3337" |
| | CDS | 3334..3585<br>/product="orf(11,21340,1100,9)$zz$ORF @ 3333-3585" |
| | CDS | complement(4060..4176)<br>/product="A(11,21340,1100,3)$zz$hypothetical protein" |
| | CDS | 4381..5202<br>/product="-> pfam00378(6,234)[125.3] \| COG1024(1,234)[162.7] : A(11,21340,1100,4)$zz$enoyl-CoA hydratase & KO:K01692" |
| | CDS | complement(4725..5033)<br>/product="orf(11,21340,1100,11)$zz$ORF @ 4724-5033" |
| | CDS | 5228..5365<br>/product="A(11,21340,1100,5)$zz$hypothetical protein" |
| | CDS | 5410..6996<br>/product="-> pfam00474(44,448)[205.1] \| COG0591(12,508)[285.1] : A(11,21340,1100,6)$zz$sodium/proline symporter & KO:K11928" |
| | CDS | 5568..5753<br>/product="orf(11,21340,1100,13)$zz$ORF @ 5567-5753" |
| | CDS | complement(5706..5873)<br>/product="orf(11,21340,1100,14)$zz$ORF @ 5705-5873" |
| | CDS | complement(5886..6155)<br>/product="orf(11,21340,1100,15)$zz$ORF @ 5885-6155" |
| | CDS | complement(6240..6470)<br>/product="orf(11,21340,1100,16)$zz$ORF @ 6239-6470" |
| | CDS | complement(6985..7173)<br>/product="orf(11,21340,1100,17)$zz$ORF @ 6984-7173" |
| | CDS | 7188..7382<br>/product="orf(11,21340,1100,18)$zz$ORF @ 7187-7382" |
| | CDS | complement(7646..8017)<br>/product="orf(11,21340,1100,19)$zz$ORF @ 7645-8017" |
| | CDS | 7692..8381<br>/product="-> pfam00589(45,218)[91.9] \| COG4974(14,228)[107.1] : A(11,21340,1100,7)$zz$integrase/recombinase XerD & KO:K04763" |
| | CDS | complement(8304..8609)<br>/product="orf(11,21340,1100,21)$zz$ORF @ 8303-8609" |
| | CDS | 8397..8624<br>/product="A(11,21340,1100,8)$zz$hypothetical protein" |
| | CDS | 8636..8884<br>/product="A(11,21340,1100,9)$zz$hypothetical protein" |
| | POI | 9364..12198<br>/product="-> IscB(1,66)[30.5] \| IscB(349,453)[39.7] \| pfam14239(1,92)[32.3] \| pfam13395(405,452)[22.1] : A(11,21340,1100,10)$zz$RRXRR protein/HNH endonuclease & pfam14239,pfam13395" |
| | CDS | 9364..12198<br>/product="-> IscB(1,66)[30.5] \| IscB(349,453)[39.7] \| pfam14239(1,92)[32.3] \| pfam13395(405,452)[22.1] : A(11,21340,1100,10)$zz$RRXRR protein/HNH endonuclease & pfam14239,pfam13395" |
| | CDS | complement(9995..10180)<br>/product="orf(11,21340,1100,25)$zz$ORF @ 9994-10180" |
| | CDS | complement(10078..10254)<br>/product="orf(11,21340,1100,26)$zz$ORF @ 10077-10254" |
| | CDS | 10478..10702<br>/product="orf(11,21340,1100,27)$zz$ORF @ 10477-10702" |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | CDS | complement(11221..11481) /product="orf(11,21340,1100,28)$zz$ORF @ 11220-11481" |
| | CDS | complement(11608..11838) /product="orf(11,21340,1100,29)$zz$ORF @ 11607-11838" |
| | CDS | complement(12037..12219) /product="orf(11,21340,1100,30)$zz$ORF @ 12036-12219" |
| | DR | 12397..12432 |
| | DR | 12467..12502 |
| | DR | 12562..12597 |
| | DR | 12632..12667 |
| | DR | 12701..12736 |
| | DR | 12771..12806 |
| | DR | 12842..12877 |
| | DR | 12912..12947 |
| | CDS | complement(12919..13104) /product="orf(11,21340,1100,31)$zz$ORF @ 12918-13104" |
| | CDS | complement(13688..14137) /product="orf(11,21340,1100,32)$zz$ORF @ 13687-14137" |
| | CDS | 13703..14719 /product="–> pfam02800(158,314)[217.9] \| pfam00044(3,104)[116.0] \| COG0057(2,336)[439.4] : A(11,21340,1100,11)$zz$glyceraldehyde 3-phosphate dehydrogenase & KO:K00134" |
| | CDS | complement(13852..14100) /product="orf(11,21340,1100,34)$zz$ORF @ 13851-14100" |
| | CDS | complement(14572..14808) /product="orf(11,21340,1100,35)$zz$ORF @ 14571-14808" |
| | CDS | 14720..15478 /product="–> pfam00121(4,247)[309.0] \| COG0149(1,250)[303.4] : A(11,21340,1100,12)$zz$triosephosphate isomerase & KO:K01803" |
| | CDS | complement(14819..15019) /product="orf(11,21340,1100,37)$zz$ORF @ 14818-15019" |
| | CDS | complement(15310..15963) /product="orf(11,21340,1100,38)$zz$ORF @ 15309-15963" |
| | CDS | 15499..15885 /product="–> pfam03840(4,72)[77.1] \| COG1314(1,93)[77.3] :A(11,21340,1100,13)$zz$preprotein translocase subunit SecG& KO:K03075" |
| | CDS | complement(15831..16052) /product="orf(11,21340,1100,40)$zz$ORF @ 15830-16052" |
| | CDS | complement(15956..16144) /product="orf(11,21340,1100,41)$zz$ORF @ 15955-16144" |
| | CDS | complement(16277..16459) /product="orf(11,21340,1100,42)$zz$ORF @ 16276-16459" |
| | CDS | complement(16297..16494) /product="–> pfam03966(4,43)[29.8] \| COG2835(3,60)[66.2] :A(11,21340,1100,14)$zz$hypothetical protein" |
| | CDS | 16399..16605 /product="orf(11,21340,1100,44)$zz$ORF @ 16398-16605" |
| | CDS | 16406..16585 /product="orf(11,21340,1100,45)$zz$ORF @ 16405-16585" |
| | CDS | complement(16500..17594) /product="–> pfam01075(79,325)[177.5] \| COG0859(1,343)[268.6] : A(11,21340,1100,15)$zz$3-deoxy-D-manno-octulosonic-acid transferase/heptosyltransferase-1 & KO:K02527,KO:K02841" |
| | CDS | 16621..16821 /product="orf(11,21340,1100,47)$zz$ORF @ 16620-16821" |
| | CDS | 16773..17270 /product="orf(11,21340,1100,48)$zz$ORF @ 16772-17270" |
| | CDS | complement(17356..17718) /product="orf(11,21340,1100,49)$zz$ORF @ 17355-17718" |
| | CDS | 17451..17648 /product="orf(11,21340,1100,50)$zz$ORF @ 17450-17648" |
| | CDS | complement(17591..18151) /product="–> pfam13242(107,181)[50.9] \| COG0241(1,182)[163.6] : A(11,21340,1100,16)$zz$D-glycero-D-manno-heptose 1,7-bisphosphate phosphatase & KO:K03273" |
| | CDS | 17717..18160 /product="orf(11,21340,1100,52)$zz$ORF @ 17716-18160" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | complement(18148..19227)<br>/product="–> pfam01075(84,332)[168.0] \| COG0859(16,355)[250.7] : A(11,21340,1100,17)$zz$heptosyltransferase-2 & KO:K02843" |
| | | CDS | 18169..19242<br>/product="orf(11,21340,1100,54)$zz$ORF @ 18168-19242" |
| | | CDS | 18224..18622<br>/product="orf(11,21340,1100,55)$zz$ORF @ 18223-18622" |
| | | CDS | complement(18743..18976)<br>/product="orf(11,21340,1100,56)$zz$ORF @ 18742-18976" |
| | | CDS | complement(18831..19013)<br>/product="orf(11,21340,1100,57)$zz$ORF @ 18830-19013" |
| | | CDS | 19019..19234<br>/product="orf(11,21340,1100,58)$zz$ORF @ 19018-19234" |
| | | CDS | complement(19221..20105)<br>/product="–> pfam03279(6,286)[176.5] \| COG1560(2,294)[222.3] : A(11,21340,1100,18)$zz$KDO2-lipid IV(A) lauroyltransferase & KO:K02517"' |
| | | CDS | 19290..20057<br>/product="orf(11,21340,1100,60)$zz$ORF @ 19289-20057" |
| | | CDS | 19429..19692<br>/product="orf(11,21340,1100,61)$zz$ORF @ 19428-19692" |
| | | CDS | complement(20102..21208)<br>/product="–> pfam02606(27,366)[311.5] \| COG1663(20,366)[268.2] : A(11,21340,1100,19)$zz$tetraacyldisaccharide 4'-kinase & KO:K00912" |
| | | CDS | 20312..20497<br>/product="orf(11,21340,1100,63)$zz$ORF @ 20311-20497" |
| | | CDS | 20463..20909<br>/product="orf(11,21340,1100,64)$zz$ORF @ 20462-20909" |
| | | CDS | 20630..21412<br>/product="orf(11,21340,1100,65)$zz$ORF @ 20629-21412" |
| | | CDS | 21177..21767<br>/product="orf(11,21340,1100,66)$zz$ORF @ 21176-21767" |
| | | CDS | 21346..21633<br>/product="orf(11,21340,1100,68)$zz$ORF @ 21345-21633" |
| | | CDS | 21661..21834<br>/product="orf(11,21340,1100,69)$zz$ORF @ 21660-21834" |
| | | CDS | 21844..22128<br>/product="orf(11,21340,1100,70)$zz$ORF @ 21843-22128" |
| 101 | PMZF01000021.1 (Accession PMZF01000021) | CDS | 399..587<br>/product="orf(28,161430,67,3)$zz$ORF @ 1185-1374" |
| | | CDS | complement(643..912)<br>/product="orf(28,161430,67,4)$zz$ORF @ 1429-1699" |
| | | CDS | complement(998..1846)<br>/product="orf(28,161430,67,5)$zz$ORF @ 1784-2633" |
| | | CDS | 1127..1840<br>/product="orf(28,161430,67,6)$zz$ORF @ 1913-2627" |
| | | CDS | complement(1311..1718)<br>/product="orf(28,161430,67,7)$zz$ORF @ 2097-2505" |
| | | CDS | 1425..1640<br>/product="orf(28,161430,67,8)$zz$ORF @ 2211-2427" |
| | | CDS | complement(1618..2391)<br>/product="orf(28,161430,67,9)$zz$ORF @ 2404-3178" |
| | | CDS | 1717..2079<br>/product="orf(28,161430,67,10)$zz$ORF @ 2503-2866" |
| | | CDS | complement(1800..1973)<br>/product="orf(28,161430,67,11)$zz$ORF @ 2586-2760" |
| | | CDS | 2176..2496<br>/product="orf(28,161430,67,12)$zz$ORF @ 2962-3283" |
| | | CDS | complement(2210..2446)<br>/product="orf(28,161430,67,13)$zz$ORF @ 2996-3233" |
| | | CDS | complement(2539..3519)<br>/product="orf(28,161430,67,14)$zz$ORF @ 3325-4306" |
| | | CDS | 2615..2842<br>/product="orf(28,161430,67,15)$zz$ORF @ 3401-3629" |
| | | CDS | 2776..3300<br>/product="orf(28,161430,67,16)$zz$ORF @ 3562-4087" |
| | | CDS | complement(2829..3272)<br>/product="orf(28,161430,67,17)$zz$ORF @ 3615-4059" |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | CDS | 3009..3263<br>/product="orf(28,161430,67,18)$zz$ORF @ 3795-4050" |
| | CDS | 3314..3499<br>/product="orf(28,161430,67,19)$zz$ORF @ 4100-4286" |
| | CDS | complement(3327..3497)<br>/product="orf(28,161430,67,20)$zz$ORF @ 4113-4284" |
| | CDS | 3358..4194<br>/product="orf(28,161430,67,21)$zz$ORF @ 4144-4981" |
| | CDS | complement(3544..4236)<br>/product="orf(28,161430,67,22)$zz$ORF @ 4330-5023" |
| | CDS | 3548..3715<br>/product="orf(28,161430,67,23)$zz$ORF @ 4334-4502" |
| | CDS | 4204..4638<br>/product="orf(28,161430,67,24)$zz$ORF @ 4990-5425" |
| | CDS | complement(4243..4575)<br>/product="orf(28,161430,67,25)$zz$ORF @ 5029-5362" |
| | CDS | complement(4493..6499)<br>/product="orf(28,161430,67,26)$zz$ORF @ 5279-7286" |
| | CDS | 4556..4753<br>/product="orf(28,161430,67,27)$zz$ORF @ 5342-5540" |
| | CDS | 4683..5237<br>/product="orf(28,161430,67,28)$zz$ORF @ 5469-6024" |
| | CDS | 4835..5905<br>/product="orf(28,161430,67,29)$zz$ORF @ 5621-6692" |
| | CDS | complement(5169..5882)<br>/product="orf(28,161430,67,30)$zz$ORF @ 5955-6669" |
| | CDS | complement(5985..6185)<br>/product="orf(28,161430,67,31)$zz$ORF @ 6771-6972" |
| | CDS | 5987..6544<br>/product="orf(28,161430,67,32)$zz$ORF @ 6773-7331" |
| | CDS | 6532..6807<br>/product="orf(28,161430,67,33)$zz$ORF @ 7318-7594" |
| | CDS | complement(6541..6963)<br>/product="orf(28,161430,67,34)$zz$ORF @ 7327-7750" |
| | CDS | complement(6638..7174)<br>/product="orf(28,161430,67,35)$zz$ORF @ 7424-7961" |
| | CDS | 6782..7261<br>/product="orf(28,161430,67,36)$zz$ORF @ 7568-8048" |
| | CDS | 7186..9426<br>/product="orf(28,161430,67,37)$zz$ORF @ 7972-10213" |
| | CDS | complement(7233..7685)<br>/product="orf(28,161430,67,38)$zz$ORF @ 8019-8472" |
| | CDS | 7596..8087<br>/product="orf(28,161430,67,39)$zz$ORF @ 8382-8874" |
| | CDS | complement(7732..8091)<br>/product="orf(28,161430,67,40)$zz$ORF @ 8518-8878" |
| | CDS | complement(8027..8380)<br>/product="orf(28,161430,67,41)$zz$ORF @ 8813-9167" |
| | CDS | complement(8119..8301)<br>/product="orf(28,161430,67,42)$zz$ORF @ 8905-9088" |
| | CDS | 8618..8869<br>/product="orf(28,161430,67,43)$zz$ORF @ 9404-9656" |
| | CDS | complement(8727..9086)<br>/product="orf(28,161430,67,44)$zz$ORF @ 9513-9873" |
| | CDS | 9444..10040<br>/product="orf(28,161430,67,45)$zz$ORF @ 10230-10827" |
| | POI | 10001..12841<br>/product="–> IscB(349,452)[41.8] :<br>orf(28,161430,67,46)$zz$ORF @ 10787-13628" |
| | CDS | 10001..12841<br>/product="–> IscB(349,452)[41.8] :<br>orf(28,161430,67,46)$zz$ORF @ 10787-13628" |
| | CDS | complement(10021..10254)<br>/product="orf(28,161430,67,47)$zz$ORF @ 10807-11041" |
| | CDS | complement(10106..10321)<br>/product="orf(28,161430,67,48)$zz$ORF @ 10892-11108" |
| | CDS | complement(10631..11260)<br>/product="orf(28,161430,67,49)$zz$ORF @ 11417-12047" |
| | CDS | 11212..11829<br>/product="orf(28,161430,67,50)$zz$ORF @ 11998-12616" |
| | CDS | complement(11727..12203)<br>/product="orf(28,161430,67,51)$zz$ORF @ 12513-12990" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | complement(11813..12121) /product="orf(28,161430,67,52)$zz$ORF @ 12599-12908" |
| | | CDS | complement(12278..12859) /product="orf(28,161430,67,53)$zz$ORF @ 13064-13646" |
| | | DR | 13048..13084 |
| | | DR | 13122..13158 |
| | | DR | 13192..13228 |
| | | DR | 13263..13299 |
| | | CDS | 13285..13551 /product="orf(28,161430,67,54)$zz$ORF @ 14071-14338" |
| | | DR | 13333..13369 |
| | | CDS | 13397..13621 /product="orf(28,161430,67,55)$zz$ORF @ 14183-14408" |
| | | CDS | 13780..14436 /product="orf(28,161430,67,56)$zz$ORF @ 14566-15223" |
| | | CDS | complement(14125..14430) /product="orf(28,161430,67,57)$zz$ORF @ 14911-15217" |
| | | CDS | complement(14168..15562) /product="orf(28,161430,67,58)$zz$ORF @ 14954-16349" |
| | | CDS | 14198..15550 /product="orf(28,161430,67,59)$zz$ORF @ 14984-16337" |
| | | CDS | 14770..15834 /product="orf(28,161430,67,60)$zz$ORF @ 15556-16621" |
| | | CDS | complement(15178..15405) /product="orf(28,161430,67,61)$zz$ORF @ 15964-16192" |
| | | CDS | 15555..16733 /product="orf(28,161430,67,62)$zz$ORF @ 16341-17520" |
| | | CDS | complement(15779..15961) /product="orf(28,161430,67,63)$zz$ORF @ 16565-16748" |
| | | CDS | complement(16149..16376) /product="orf(28,161430,67,64)$zz$ORF @ 16935-17163" |
| | | CDS | 16312..16512 /product="orf(28,161430,67,65)$zz$ORF @ 17098-17299" |
| | | CDS | 16367..17077 /product="orf(28,161430,67,66)$zz$ORF @ 17153-17864" |
| | | CDS | complement(16743..16946) /product="orf(28,161430,67,67)$zz$ORF @ 17529-17733" |
| | | CDS | complement(16814..17788) /product="orf(28,161430,67,68)$zz$ORF @ 17600-18575" |
| | | CDS | 17634..18008 /product="orf(28,161430,67,69)$zz$ORF @ 18420-18795" |
| | | CDS | complement(17891..18061) /product="orf(28,161430,67,70)$zz$ORF @ 18677-18848" |
| | | CDS | complement(18058..18384) /product="orf(28,161430,67,71)$zz$ORF @ 18844-19171" |
| | | CDS | 18312..18710 /product="orf(28,161430,67,72)$zz$ORF @ 19098-19497" |
| | | CDS | 18422..18601 /product="orf(28,161430,67,73)$zz$ORF @ 19208-19388" |
| | | CDS | complement(18547..19263) /product="orf(28,161430,67,74)$zz$ORF @ 19333-20050" |
| | | CDS | 18562..19308 /product="orf(28,161430,67,75)$zz$Partial ORF @ 19348-20095" |
| | | CDS | 18692..18910 /product="orf(28,161430,67,76)$zz$ORF @ 19478-19697" |
| 102 | 0172371_10038057 (Accession 0172371_10038057) | CDS | 19..201 /product="orf(16,31096,38056,15)$zz$Partial ORF @ 5079-5262" |
| | | CDS | 580..837 /product="A(16,31096,38056,3)$zz$integration host factor subunit beta & KO:K05788" |
| | | CDS | complement(855..1022) /product="orf(16,31096,38056,13)$zz$ORF @ 4258-4426" |
| | | CDS | 874..1530 /product="A(16,31096,38056,2)$zz$hypothetical protein & Hypo-rule applied" |
| | | CDS | complement(1150..1332) /product="orf(16,31096,38056,12)$zz$ORF @ 3948-4131" |
| | | CDS | complement(1182..1403) /product="orf(16,31096,38056,11)$zz$ORF @ 3877-4099" |
| | | CDS | complement(1652..1849) /product="orf(16,31096,38056,8)$zz$ORF @ 3431-3629" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | complement(1656..1844)<br>/product="orf(16,31096,38056,9)$zz$ORF @ 3436-3625" |
| | | CDS | 1719..1877<br>/product="A(16,31096,38056,1)$zz$hypothetical protein & Hypo-rule applied" |
| | | POI | 2014..4872<br>/product="–> IscB(1,165)[29.7] | IscB(344,443)[44.9] : A(16,31096,38056,0)$zz$RRXRR protein & pfam14239" |
| | | CDS | 2014..4872<br>/product="–> IscB(1,165)[29.7] | IscB(344,443)[44.9] : A(16,31096,38056,0)$zz$RRXRR protein & pfam14239" |
| | | CDS | complement(2874..3047)<br>/product="orf(16,31096,38056,7)$zz$ORF @ 2233-2407" |
| | | CDS | 3113..3358<br>/product="orf(16,31096,38056,6)$zz$ORF @ 1922-2168" |
| | | CDS | complement(3241..3438)<br>/product="orf(16,31096,38056,5)$zz$ORF @ 1842-2040" |
| | | CDS | 3740..3946<br>/product="orf(16,31096,38056,4)$zz$ORF @ 1334-1541" |
| | | CDS | complement(4328..4504)<br>/product="orf(16,31096,38056,3)$zz$ORF @ 776-953" |
| | | CDS | 4668..4862<br>/product="orf(16,31096,38056,2)$zz$ORF @ 418-613" |
| | | DR | 5068..5095 |
| | | DR | 5068..5096 |
| | | CDS | complement(5098..5280)<br>/product="orf(16,31096,38056,0)$zz$Partial ORF @ 0-183" |
| | | DR | 5138..5165 |
| | | DR | 5138..5166 |
| 103 | 0299912_10028469 (Accession 0299912_10028469) | CDS | complement(3..209)<br>/product="orf(4,280876,28468,0)$zz$Partial ORF @ 2-209" |
| | | CDS | 131..301<br>/product="orf(4,280876,28468,1)$zz$ORF @ 130-301" |
| | | CDS | 361..1368<br>/product="A(4,280876,28468,0)$zz$hypothetical protein" |
| | | CDS | complement(401..742)<br>/product="orf(4,280876,28468,3)$zz$ORF @ 400-742" |
| | | CDS | complement(462..707)<br>/product="orf(4,280876,28468,4)$zz$ORF @ 461-707" |
| | | CDS | complement(1029..1211)<br>/product="orf(4,280876,28468,5)$zz$ORF @ 1028-1211" |
| | | CDS | 1390..2379<br>/product="orf(4,280876,28468,6)$zz$ORF @ 1389-2379" |
| | | CDS | 2471..2674<br>/product="orf(4,280876,28468,7)$zz$ORF @ 2470-2674" |
| | | CDS | 2575..2754<br>/product="A(4,280876,28468,2)$zz$hypothetical protein" |
| | | CDS | 2771..2908<br>/product="A(4,280876,28468,3)$zz$hypothetical protein" |
| | | POI | 2983..4839<br>/product="–> IscB(11,181)[32.0] | IscB(384,460)[31.6] | pfam14239(2,167)[29.0] | pfam13395(420,468)[24.0] : A(4,280876,28468,4)$zz$RRXRR protein/HNH endonuclease & pfam14239,pfam13395" |
| | | CDS | 2983..4839<br>/product="–> IscB(11,181)[32.0] | IscB(384,460)[31.6] | pfam14239(2,167)[29.0] | pfam13395(420,468)[24.0] : A(4,280876,28468,4)$zz$RRXRR protein/HNH endonuclease & pfam14239,pfam13395" |
| | | CDS | complement(3135..3602)<br>/product="orf(4,280876,28468,10)$zz$ORF @ 3134-3602" |
| | | CDS | complement(3424..3717)<br>/product="orf(4,280876,28468,11)$zz$ORF @ 3423-3717" |
| | | CDS | 3563.3790<br>/product="orf(4,280876,28468,12)$zz$ORF @ 3562-3790" |
| | | CDS | complement(3805..4287)<br>/product="orf(4,280876,28468,13)$zz$ORF @ 3804-4287" |
| | | CDS | complement(4396..4839)<br>/product="orf(4,280876,28468,14)$zz$Partial ORF @ 4395-4839" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| 104 | 0180436__10000059 (Accession 0180436__10000059) | CDS | 172..354 /product="orf(18,35201,58,49)$zz$ORF @ 12749-12932" |
| | | CDS | complement(428..628) /product="orf(18,35201,58,47)$zz$ORF @ 12475-12676" |
| | | DR | 697..712 |
| | | CDS | complement(727..1020) /product="orf(18,35201,58,45)$zz$ORF @ 12083-12377" |
| | | DR | 742..757 |
| | | CDS | 908..1183 /product="orf(18,35201,58,44)$zz$ORF @ 11920-12196" |
| | | CDS | complement(917..4624) /product="–> pfam02837(107,289)[69.5] \| pfam00703(291,392)[33.1] \| COG3250(97,571)[138.9] : A(18,35201,58,6)$zz$Beta-galactosidase/beta-glucuronidase & COG3250" |
| | | CDS | complement(972..1949) /product="orf(18,35201,58,41)$zz$ORF @ 11154-12132" |
| | | CDS | 1250..1624 /product="orf(18,35201,58,43)$zz$ORF @ 11479-11854" |
| | | CDS | complement(1621..1854) /product="orf(18,35201,58,42)$zz$ORF @ 11249-11483" |
| | | CDS | 1931..2104 /product="orf(18,35201,58,40)$zz$ORF @ 10999-11173" |
| | | CDS | 2222..2854 /product="orf(18,35201,58,38)$zz$ORF @ 10249-10882" |
| | | CDS | complement(2226..2888) /product="orf(18,35201,58,37)$zz$ORF @ 10215-10878" |
| | | CDS | complement(2350..2673) /product="orf(18,35201,58,39)$zz$ORF @ 10430-10754" |
| | | CDS | 3104..3313 /product="orf(18,35201,58,36)$zz$ORF @ 9790-10000" |
| | | CDS | complement(3274..3489) /product="orf(18,35201,58,35)$zz$ORF @ 9614-9830" |
| | | CDS | complement(3411..3707) /product="orf(18,35201,58,34)$zz$ORF @ 9396-9693" |
| | | CDS | 3524..4552 /product="orf(18,35201,58,32)$zz$ORF @ 8551-9580" |
| | | CDS | 4132..4299 /product="orf(18,35201,58,33)$zz$ORF @ 8804-8972" |
| | | CDS | complement(4605..4913) /product="–> pfam13936(3,36)[28.6] : A(18,35201,58,5)$zz$Helix-turn-helix domain-containing protein & pfam13936" |
| | | CDS | 4958..5158 /product="orf(18,35201,58,29)$zz$ORF @ 7945-8146" |
| | | CDS | 5155..5334 /product="orf(18,35201,58,28)$zz$ORF @ 7769-7949" |
| | | CDS | 5316..5519 /product="A(18,35201,58,4)$zz$hypothetical protein & Hypo-rule applied" |
| | | CDS | complement(5582..7768) /product="–> pfam00400(601,639)[39.0] \| pfam00400(558,594)[38.1] \| pfam00400(512,549)[37.5] \| pfam00400(277,313)[31.3] \| pfam00400(468,504)[30.7] \| pfam00400(647,690)[29.2] \| pfam00400(320,358)[28.9] \| pfam00400(368,423)[15.8] \| COG2319(467,700)[143.5] \| COG2319(266,436)[57.9] : A(18,35201,58,3)$zz$WD40 repeat/WD40 repeat & COG2319,COG2319" |
| | | CDS | 5804..6457 /product="orf(18,35201,58,26)$zz$ORF @ 6646-7300" |
| | | CDS | complement(6072..6740) /product="orf(18,35201,58,25)$zz$ORF @ 6363-7032" |
| | | CDS | 6384..6782 /product="orf(18,35201,58,24)$zz$ORF @ 6321-6720" |
| | | CDS | 6551..7756 /product="orf(18,35201,58,22)$zz$ORF @ 5347-6553" |
| | | CDS | complement(6754..6933) /product="orf(18,35201,58,23)$zz$ORF @ 6170-6350" |
| | | CDS | complement(7590..8030) /product="orf(18,35201,58,19)$zz$ORF @ 5073-5514" |
| | | CDS | complement(7624..8025) /product="orf(18,35201,58,20)$zz$ORF @ 5078-5480" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | 7651..8880<br>/product="–> pfam04542(21,89)[44.3] \| COG1595(4,128)[63.0]: orf(18,35201,58,18)$zz$ORF @ 4223-5453" |
| | | CDS | 8576..8962<br>/product="orf(18,35201,58,16)$zz$ORF @ 4141-4528" |
| | | CDS | complement(8724..8912)<br>/product="orf(18,35201,58,17)$zz$ORF @ 4191-4380" |
| | | CDS | complement(8999..9193)<br>/product="orf(18,35201,58,15)$zz$ORF @ 3910-4105" |
| | | CDS | complement(9067..9258)<br>/product="orf(18,35201,58,14)$zz$ORF @ 3845-4037" |
| | | DR | 9202..9238 |
| | | DR | 9275..9311 |
| | | DR | 9347..9383 |
| | | DR | 9418..9454 |
| | | DR | 9489..9525 |
| | | DR | 9559..9595 |
| | | DR | 9632..9668 |
| | | DR | 9701..9737 |
| | | CDS | complement(9704..10063)<br>/product="orf(18,35201,58,13)$zz$ORF @ 3040-3400" |
| | | DR | 9775..9811 |
| | | CDS | complement(9778..10092)<br>/product="orf(18,35201,58,12)$zz$ORF @ 3011-3326" |
| | | POI | 10001..12841<br>/product="–> IscB(351,453)[44.8] \| pfam13395(407,452)[29.2] \| COG1403(363,466)[27.4] : A(18,35201,58,1)$zz$5-methylcytosine-specific restriction endonuclease McrA & COG1403" |
| | | CDS | 10001..12841<br>/product="–> IscB(351,453)[44.8] \| pfam13395(407,452)[29.2] \| COG1403(363,466)[27.4] : A(18,35201,58,1)$zz$5-methylcytosine-specific restriction endonuclease McrA & COG1403" |
| | | CDS | 10062..10406<br>/product="orf(18,35201,58,10)$zz$ORF @ 2697-3042" |
| | | CDS | 10126..10362<br>/product="orf(18,35201,58,11)$zz$ORF @ 2741-2978" |
| | | CDS | complement(10409..11431)<br>/product="orf(18,35201,58,8)$zz$ORF @ 1672-2695" |
| | | CDS | 10605..10844<br>/product="orf(18,35201,58,9)$zz$ORF @ 2259-2499" |
| | | CDS | complement(11628..11816)<br>/product="orf(18,35201,58,7)$zz$ORF @ 1287-1476" |
| | | CDS | 11730..11939<br>/product="orf(18,35201,58,6)$zz$ORF @ 1164-1374" |
| | | CDS | complement(11753..12100)<br>/product="orf(18,35201,58,5)$zz$ORF @ 1003-1351" |
| | | CDS | complement(11920..12315)<br>/product="orf(18,35201,58,3)$zz$ORF @ 788-1184" |
| | | CDS | 12009..12191<br>/product="orf(18,35201,58,4)$zz$ORF @ 912-1095" |
| | | CDS | 12372..12542<br>/product="orf(18,35201,58,2)$zz$ORF @ 561-732" |
| | | CDS | 12882..13103<br>/product="orf(18,35201,58,0)$zz$Partial ORF @ 0-222" |
| | | CDS | complement(12996..13103)<br>/product="A(18,35201,58,0)$zz$hypothetical protein & Hypo-rule applied" |
| 105 | 0214473_10118860<br>(Accession<br>0214473_10118860) | CDS | complement(3..554)<br>/product="orf(4,280878,118859,9)$zz$Partial ORF @ 2532-3084" |
| | | CDS | 3..206<br>/product="orf(4,280878,118859,12)$zz$Partial ORF @ 2880-3084" |
| | | CDS | 22..231<br>/product="orf(4,280878,118859,11)$zz$Partial ORF @ 2855-3065" |
| | | CDS | 231..425<br>/product="orf(4,280878,118859, 10)$zz$ORF @ 2661-2856" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | complement(350..697) /product="orf(4,280878,118859,8)$zz$ORF @ 2389-2737" |
| | | DR | 739..775 |
| | | DR | 809..845 |
| | | CDS | 839..1036 /product="orf(4,280878,118859,7)$zz$ORF @ 2050-2248" |
| | | DR | 881..917 |
| | | DR | 950..986 |
| | | DR | 1021..1057 |
| | | DR | 1092..1128 |
| | | DR | 1164..1200 |
| | | DR | 1235..1271 |
| | | POI | 1466..3085 /product="-> IscB(1,158)[25.2] | IscB(349,449)[49.7] : A(4,280878,118859,0)$zz$hypothetical protein" |
| | | CDS | 1466..3085 /product="-> IscB(1,158)[25.2] | IscB(349,449)[49.7] : A(4,280878,118859,0)$zz$hypothetical protein" |
| | | CDS | complement(1874..2812) /product="orf(4,280878,118859,4)$zz$ORF @ 274-1213" |
| | | CDS | 1995..2303 /product="orf(4,280878,118859,6)$zz$ORF @ 783-1092" |
| | | CDS | complement(2374..2550) /product="orf(4,280878,118859,5)$zz$ORF @ 536-713" |
| | | CDS | 2586..3086 /product="orf(4,280878,118859,0)$zz$Partial ORF @ 0-501" |
| | | CDS | complement(2683..2859) /product="orf(4,280878,118859,3)$zz$ORF @ 227-404" |
| | | CDS | complement(2763..3065) /product="orf(4,280878,118859,2)$zz$Partial ORF @ 21-324" |
| 106 | PVMK01116787.1 (Accession PVMK01116787) | CDS | complement(2..196) /product="orf(7,14485,8884,0)$zz$Partial ORF @ 1-196" |
| | | CDS | complement(193..879) /product="orf(7,14485,8884,1)$zz$ORF @ 192-879" |
| | | CDS | 355..594 /product="orf(7,14485,8884,2)$zz$ORF @ 354-594" |
| | | CDS | 715..921 /product="orf(7,14485,8884,3)$zz$ORF @ 714-921" |
| | | CDS | complement(918..1217) /product="orf(7,14485,8884,4)$zz$ORF @ 917-1217" |
| | | POI | 1583..4441 /product="-> IscB(1,64)[28.8] | IscB(351,451)[46.3] : orf(7,14485,8884,5)$zz$ORF @ 1582-4441" |
| | | CDS | 1583..4441 /product="-> IscB(1,64)[28.8] | IscB(351,451)[46.3] : orf(7,14485,8884,5)$zz$ORF @ 1582-4441" |
| | | CDS | complement(1846..2436) /product="orf(7,14485,8884,6)$zz$ORF @ 1845-2436" |
| | | CDS | 2394..2624 /product="orf(7,14485,8884,7)$zz$ORF @ 2393-2624" |
| | | DR | 4616..4640 |
| | | DR | 4688..4712 |
| | | DR | 4759..4783 |
| | | DR | 4830..4854 |
| | | DR | 4901..4925 |
| | | CDS | complement(5063..5683) /product="orf(7,14485,8884,8)$zz$ORF @ 5062-5683" |
| | | CDS | 5172..5402 /product="orf(7,14485,8884,9)$zz$ORF @ 5171-5402" |
| | | CDS | 5460..5879 /product="orf(7,14485,8884, 10)$zz$ORF @ 5459-5879" |
| | | CDS | complement(5935..6219) /product="orf(7,14485,8884,11)$zz$ORF @ 5934-6219" |
| | | CDS | 5939..6169 /product="orf(7,14485,8884,12)$zz$ORF @ 5938-6169" |
| | | CDS | 6325..6708 /product="orf(7,14485,8884,13)$zz$ORF @ 6324-6708" |
| 107 | 0315281_10101262 (Accession 0315281_10101262) | POI | 368..3223 /product="-> IscB(1,67)[31.2] | IscB(371,446)[37.0] | pfam14239(1,84)[27.2] | pfam13395(407,455)[23.4] : A(7,281632,101261,0)$zz$RRXRR protein/HNH endonuclease & pfam14239,pfam13395" |

// TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | 368..3223<br>/product="−> IscB(1,67)[31.2] | IscB(371,446)[37.0] | pfam14239(1,84)[27.2] | pfam13395(407,455)[23.4] : A(7,281632,101261,0)$zz$RRXRR protein/HNH endonuclease & pfam14239,pfam13395" |
| | | CDS | 909..1127<br>/product="orf(7,281632, 101261,7)$zz$ORF @ 2213-2432" |
| | | CDS | complement(961..1209)<br>/product="orf(7,281632,101261,6)$zz$ORF @ 2131-2380" |
| | | CDS | complement(1334..1525)<br>/product="orf(7,281632,101261,5)$zz$ORF @ 1815-2007" |
| | | CDS | complement(1488..1763)<br>/product="orf(7,281632,101261,4)$zz$ORF @ 1577-1853" |
| | | CDS | complement(1775..2107)<br>/product="orf(7,281632,101261,3)$zz$ORF @ 1233-1566" |
| | | CDS | 2436..2603<br>/product="orf(7,281632,101261,2)$zz$ORF @ 737-905" |
| | | CDS | complement(3159..3338)<br>/product="orf(7,281632,101261,0)$zz$Partial ORF @ 2-182" |
| 108 | 0187854_10007072<br>(Accession 0187854_10007072) | CDS | complement(213..452)<br>/product="orf(16,30420,7071,18)$zz$ORF @ 7194-7434" |
| | | CDS | complement(571..1173)<br>/product="orf(16,30420,7071,15)$zz$ORF @ 6473-7076" |
| | | CDS | 863..1165<br>/product="orf(16,30420,7071,16)$zz$ORF @ 6481-6784" |
| | | CDS | complement(1002..1226)<br>/product="orf(16,30420,7071,14)$zz$ORF @ 6420-6645" |
| | | CDS | 1677..1787<br>/product="A(16,30420,7071,3)$zz$hypothetical protein & Hypo-rule applied" |
| | | DR | 1772..1806 |
| | | DR | 1842..1876 |
| | | DR | 1912..1946 |
| | | CDS | complement(1915..2124)<br>/product="orf(16,30420,7071,13)$zz$ORF @ 5522-5732" |
| | | DR | 1983..2017 |
| | | DR | 2054..2088 |
| | | DR | 2125..2159 |
| | | DR | 2199..2233 |
| | | DR | 2270..2304 |
| | | CDS | 2384..2707<br>/product="orf(16,30420,7071,12)$zz$ORF @ 4939-5263" |
| | | POI | 2425..5391<br>/product="−> IscB(26,189)[31.7] | IscB(374,475)[45.9] | pfam14239(18,212)[34.3] : A(16,30420,7071,2)$zz$RRXRR protein & pfam14239" |
| | | CDS | 2425..5391<br>/product="−> IscB(26,189)[31.7] | IscB(374,475)[45.9] | pfam14239(18,212)[34.3] : A(16,30420,7071,2)$zz$RRXRR protein & pfam14239" |
| | | CDS | 2795..2998<br>/product="orf(16,30420,7071,11)$zz$ORF @ 4648-4852" |
| | | CDS | complement(3181..4086)<br>/product="orf(16,30420,7071,9)$zz$ORF @ 3560-4466" |
| | | CDS | complement(3375..3584)<br>/product="orf(16,30420,7071,10)$zz$ORF @ 4062-4272" |
| | | CDS | complement(4120..4596)<br>/product="orf(16,30420,7071,7)$zz$ORF @ 3050-3527" |
| | | CDS | complement(4215..4385)<br>/product="orf(16,30420,7071,8)$zz$ORF @ 3261-3432" |
| | | CDS | complement(4416..4652)<br>/product="orf(16,30420,7071,6)$zz$ORF @ 2994-3231" |
| | | CDS | 5897..6166<br>/product="A(16,30420,7071,1)$zz$hypothetical protein & Hypo-rule applied" |
| | | CDS | complement(6193..7644)<br>/product="−> pfam02449(1,155)[31.5] : A(16,30420,7071,0)$zz$Beta-galactosidase & pfam02449" |
| | | CDS | complement(6196..7644)<br>/product="−> pfam02449(1,155)[31.5] : orf(16,30420,7071,0)$zz$Partial ORF @ 2-1451" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | 6199..6621<br>/product="orf(16,30420,7071,3)$zz$ORF @ 1025-1448" |
| | | CDS | 6653..6847<br>/product="orf(16,30420,7071,2)$zz$ORF @ 799-994" |
| | | CDS | complement(7415..7630)<br>/product="orf(16,30420,7071,1)$zz$Partial ORF @ 16-232" |
| 109 | 0311301__10009134<br>(Accession<br>0311301__10009134) | CDS | complement(1..228)<br>/product="orf(4,280981,9133,0)$zz$Partial ORF @ 0-228" |
| | | CDS | 2..847<br>/product="-> pfam03781(1,244)[125.8] \|<br>COG1262(1,245)[153.1] : orf(4,280981,9133,1)$zz$Partial ORF @ 1-847" |
| | | CDS | complement(2..760)<br>/product="orf(4,280981,9133,2)$zz$Partial ORF @ 1-760" |
| | | CDS | 104..850<br>/product="-> pfam03781(1,244)[125.8] \|<br>COG1262(1,245)[153.1] :<br>A(4,280981,9133,0)$zz$formylglycine-generating enzyme required for sulfatase activity & COG1262" |
| | | CDS | 400..573<br>/product="orf(4,280981,9133,3)$zz$ORF @ 399-573" |
| | | CDS | complement(523..708)<br>/product="orf(4,280981,9133,4)$zz$ORF @ 522-708" |
| | | CDS | 595..999<br>/product="orf(4,280981,9133,5)$zz$ORF @ 594-999" |
| | | CDS | 1002..1439<br>/product="A(4,280981,9133,1)$zz$hypothetical protein" |
| | | CDS | complement(1121..1297)<br>/product="orf(4,280981,9133,7)$zz$ORF @ 1120-1297" |
| | | CDS | 1147..1467<br>/product="orf(4,280981,9133,8)$zz$ORF @ 1146-1467" |
| | | CDS | complement(1425..1826)<br>/product="orf(4,280981,9133,9)$zz$ORF @ 1424-1826" |
| | | CDS | 1480..2184<br>/product="orf(4,280981,9133,10)$zz$ORF @ 1479-2184" |
| | | CDS | complement(1558..1752)<br>/product="orf(4,280981,9133,11)$zz$ORF @ 1557-1752" |
| | | CDS | 1934..2116<br>/product="orf(4,280981,9133,12)$zz$ORF @ 1933-2116" |
| | | CDS | complement(2064..2273)<br>/product="orf(4,280981,9133,13)$zz$ORF @ 2063-2273" |
| | | CDS | complement(2197..3054)<br>/product="A(4,280981,9133,3)$zz$hypothetical protein" |
| | | CDS | 2333..2524<br>/product="orf(4,280981,9133,15)$zz$ORF @ 2332-2524" |
| | | CDS | 2620..3090<br>/product="orf(4,280981,9133,16)$zz$ORF @ 2619-3090" |
| | | CDS | 2978..3250<br>/product="orf(4,280981,9133,17)$zz$ORF @ 2977-3250" |
| | | CDS | complement(3067..3936)<br>/product="-> pfam16872(181,259)[94.1] :<br>A(4,280981,9133,4)$zz$putative phage abortive infection protein & pfam16872" |
| | | CDS | complement(3741..3944)<br>/product="orf(4,280981,9133,19)$zz$ORF @ 3740-3944" |
| | | CDS | 3802..4029<br>/product="orf(4,280981,9133,20)$zz$ORF @ 3801-4029" |
| | | CDS | 3836..4189<br>/product="orf(4,280981,9133,21)$zz$ORF @ 3835-4189" |
| | | CDS | complement(3997..4245)<br>/product="orf(4,280981,9133,22)$zz$ORF @ 3996-4245" |
| | | CDS | 4287..4454<br>/product="orf(4,280981,9133,23)$zz$ORF @ 4286-4454" |
| | | DR | 4316..4348 |
| | | DR | 4385..4421 |
| | | CDS | complement(4412..4780)<br>/product="orf(4,280981,9133,24)$zz$ORF @ 4411-4780" |
| | | DR | 4455..4491 |
| | | CDS | 4525..4719<br>/product="orf(4,280981,9133,25)$zz$ORF @ 4524-4719" |
| | | DR | 4527..4563 |
| | | DR | 4599..4635 |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | CDS | complement(4602..4871)<br>/product="orf(4,280981,9133,26)$zz$ORF @ 4601-4871" |
| | CDS | complement(4744..5376)<br>/product="orf(4,280981,9133,27)$zz$ORF @ 4743-5376" |
| | POI | 4816..7641<br>/product="-> IscB(4,162)[31.8] | IscB(350,450)[42.6] | pfam13395(406,452)[25.0] | COG1403(375,463)[31.5] : A(4,280981,9133,5)$zz$5-methylcytosine-specific restriction endonuclease McrA & COG1403" |
| | CDS | 4816..7641<br>/product="-> IscB(4,162)[31.8] | IscB(350,450)[42.6] | pfam13395(406,452)[25.0] | COG1403(375,463)[31.5] : A(4,280981,9133,5)$zz$5-methylcytosine-specific restriction endonuclease McrA & COG1403" |
| | CDS | complement(5078..5380)<br>/product="orf(4,280981,9133,29)$zz$ORF @ 5077-5380" |
| | CDS | complement(5569..6255)<br>/product="orf(4,280981,9133,30)$zz$ORF @ 5568-6255" |
| | CDS | complement(5961..6182)<br>/product="orf(4,280981,9133,31)$zz$ORF @ 5960-6182" |
| | CDS | complement(6370..6792)<br>/product="orf(4,280981,9133,32)$zz$ORF @ 6369-6792" |
| | CDS | complement(6534..7151)<br>/product="orf(4,280981,9133,33)$zz$ORF @ 6533-7151" |
| | CDS | 6545..6754<br>/product="orf(4,280981,9133,34)$zz$ORF @ 6544-6754" |
| | CDS | complement(6761..6970)<br>/product="orf(4,280981,9133,35)$zz$ORF @ 6760-6970" |
| | CDS | complement(6925..7614)<br>/product="orf(4,280981,9133,36)$zz$ORF @ 6924-7614" |
| | CDS | complement(7359..7601)<br>/product="orf(4,280981,9133,37)$zz$ORF @ 7358-7601" |
| | CDS | complement(7547..7768)<br>/product="orf(4,280981,9133,38)$zz$ORF @ 7546-7768" |
| | CDS | 7696..7899<br>/product="orf(4,280981,9133,40)$zz$ORF @ 7695-7899" |
| | CDS | 7725..8039<br>/product="-> pfam12728(50,97)[33.7] : A(4,280981,9133,6)$zz$helix-turn-helix protein & pfam12728" |
| | CDS | complement(7859..8050)<br>/product="orf(4,280981,9133,41)$zz$ORF @ 7858-8050" |
| | CDS | complement(8175..9314)<br>/product="A(4,280981,9133,7)$zz$hypothetical protein" |
| | CDS | 8247..8579<br>/product="orf(4,280981,9133,43)$zz$ORF @ 8246-8579" |
| | CDS | 8359..8598<br>/product="orf(4,280981,9133,44)$zz$ORF @ 8358-8598" |
| | CDS | 8613..9854<br>/product="orf(4,280981,9133,45)$zz$ORF @ 8612-9854" |
| | CDS | complement(8780..9463)<br>/product="orf(4,280981,9133,46)$zz$ORF @ 8779-9463" |
| | CDS | 9689..9898<br>/product="A(4,280981,9133,8)$zz$hypothetical protein" |
| | CDS | complement(9931..10683)<br>/product="orf(4,280981,9133,48)$zz$ORF @ 9930-10683" |
| | CDS | complement(10104..10898)<br>/product="-> pfam01641(72,173)[95.0] | COG0229(65,173)[92.8] : A(4,280981,9133,9)$zz$peptide methionine sulfoxide reductase MsrB & COG0229" |
| | CDS | 10648..10989<br>/product="orf(4,280981,9133,50)$zz$ORF @ 10647-10989" |
| | CDS | complement(10720..10941)<br>/product="orf(4,280981,9133,51)$zz$ORF @ 10719-10941" |
| | CDS | 11136..11342<br>/product="orf(4,280981,9133,52)$zz$ORF @ 11135-11342" |
| | CDS | complement(11239..11553)<br>/product="orf(4,280981,9133,53)$zz$ORF @ 11238-11553" |
| | CDS | 11468..11635<br>/product="orf(4,280981,9133,54)$zz$ORF @ 11467-11635" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | 11651..12034<br>/product="–> pfam01627(32,120)[43.2] \|<br>COG2198(9,123)[45.1] : A(4,280981,9133,10)$zz$HPt<br>(histidine-containing phosphotransfer) domain-containing<br>protein & COG2198" |
| | | CDS | 12072..12434<br>/product="orf(4,280981,9133,56)$zz$ORF @ 12071-12434" |
| | | CDS | complement(12106..12402)<br>/product="orf(4,280981,9133,57)$zz$ORF @ 12105-12402" |
| | | CDS | 12109..13206<br>/product="–> pfam01266(6,356)[140.1] \|<br>COG0665(1,361)[101.1] :<br>A(4,280981,9133,11)$zz$D-amino-acid oxidase & KO:K00273" |
| | | CDS | complement(12502..13110)<br>/product="orf(4,280981,9133,59)$zz$ORF @ 12501-13110" |
| | | CDS | complement(12579..12779)<br>/product="orf(4,280981,9133,60)$zz$ORF @ 12578-12779" |
| | | CDS | 12630..12887<br>/product="orf(4,280981,9133,61)$zz$ORF @ 12629-12887" |
| | | CDS | complement(13334..14062)<br>/product="–> pfam05685(12,181)[111.3] \|<br>COG4636(1,185)[109.0] : orf(4,280981,9133,62)$zz$ORF @<br>13333-14062" |
| | | CDS | 13668..14042<br>/product="orf(4,280981,9133,63)$zz$ORF @ 13667-14042" |
| | | CDS | complement(14014..16020)<br>/product="orf(4,280981,9133,64)$zz$ORF @ 14013-16020" |
| | | CDS | 14071..14313<br>/product="orf(4,280981,9133,65)$zz$ORF @ 14070-14313" |
| | | CDS | 14132..14335<br>/product="orf(4,280981,9133,66)$zz$ORF @ 14131-14335" |
| | | CDS | complement(14196..14372)<br>/product="orf(4,280981,9133,67)$zz$ORF @ 14195-14372" |
| | | CDS | 14310..14726<br>/product="orf(4,280981,9133,68)$zz$ORF @ 14309-14726" |
| | | CDS | complement(14388..14705)<br>/product="orf(4,280981,9133,69)$zz$ORF @ 14387-14705" |
| | | CDS | 15788..16015<br>/product="orf(4,280981,9133,71)$zz$ORF @ 15787-16015" |
| | | CDS | complement(16183..16818)<br>/product="orf(4,280981,9133,72)$zz$ORF @ 16182-16818" |
| | | CDS | complement(16424..16642)<br>/product="orf(4,280981,9133,73)$zz$ORF @ 16423-16642" |
| | | CDS | 16574..16780<br>/product="orf(4,280981,9133,74)$zz$ORF @ 16573-16780" |
| | | CDS | complement(16590..16832)<br>/product="orf(4,280981,9133,75)$zz$ORF @ 16589-16832" |
| 110 | a0184636_1002691<br>(Accession<br>a0184636_1002691) | CDS | complement(1..186)<br>/product="–> pfam13437(4,62)[27.6] :<br>A(18,34054,2690,0)$zz$hemolysin D & KO:K11003" |
| | | POI | 370..3234<br>/product="–> IscB(3,171)[29.5] \| IscB(375,450)[29.1] \|<br>pfam14239(1,149)[26.3] \| pfam13395(410,458)[22.9] :<br>A(18,34054,2690,1)$zz$RRXRR protein/HNH endonuclease &<br>pfam14239,pfam13395" |
| | | CDS | 370..3234<br>/product="–> IscB(3,171)[29.5] \| IscB(375,450)[29.1] \|<br>pfam14239(1,149)[26.3] \| pfam13395(410,458)[22.9] :<br>A(18,34054,2690,1)$zz$RRXRR protein/HNH endonuclease &<br>pfam14239,pfam13395" |
| | | CDS | complement(654..827)<br>/product="orf(18,34054,2690,2)$zz$ORF @ 653-827" |
| | | CDS | complement(1312..1644)<br>/product="orf(18,34054,2690,3)$zz$ORF @ 1311-1644" |
| | | CDS | 1778..2137<br>/product="orf(18,34054,2690,4)$zz$ORF @ 1777-2137" |
| | | CDS | complement(2182..2355)<br>/product="orf(18,34054,2690,5)$zz$ORF @ 2181-2355" |
| | | DR | 3436..3472 |
| | | DR | 3508..3544 |
| | | DR | 3579..3615 |
| | | DR | 3650..3686 |
| | | DR | 3721..3757 |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | 4164..4481<br>/product="A(18,34054,2690,2)$zz$hypothetical protein & Hypo-rule applied" |
| | | CDS | complement(4178..4513)<br>/product="orf(18,34054,2690,7)$zz$ORF @ 4177-4513" |
| | | CDS | 4512..4688<br>/product="orf(18,34054,2690,9)$zz$Partial ORF @ 4511-4688" |
| 111 | 0315268_10069040<br>(Accession<br>0315268_10069040) | CDS | complement(1..111)<br>/product="A(0,279979,69039,0)$zz$hypothetical protein" |
| | | CDS | complement(92..364)<br>/product="orf(0,279979,69039,0)$zz$ORF @ 91-364" |
| | | CDS | complement(162..851)<br>/product="A(0,279979,69039,1)$zz$hypothetical protein" |
| | | CDS | 474..821<br>/product="orf(0,279979,69039,2)$zz$ORF @ 473-821" |
| | | DR | 676..695 |
| | | CDS | 883..1398<br>/product="orf(0,279979,69039,3)$zz$ORF @ 882-1398" |
| | | CDS | complement(892..1329)<br>/product="A(0,279979,69039,2)$zz$hypothetical protein" |
| | | CDS | 1274..1453<br>/product="orf(0,279979,69039,5)$zz$ORF @ 1273-1453" |
| | | CDS | complement(1563..1868)<br>/product="orf(0,279979,69039,6)$zz$ORF @ 1562-1868" |
| | | POI | 1638..3332<br>/product="-> IscB(4,65)[30.2] | IscB(355,449)[41.3] | pfam14239(2,121)[29.7] | pfam13395(411,459)[24.8] :<br>A(0,279979,69039,3)$zz$RRXRR protein/HNH endonuclease & pfam14239,pfam13395" |
| | | CDS | complement(1748..2134)<br>/product="orf(0,279979,69039,8)$zz$ORF @ 1747-2134" |
| | | CDS | 1867..2064<br>/product="orf(0,279979,69039,9)$zz$ORF @ 1866-2064" |
| | | CDS | 2218..2403<br>/product="orf(0,279979,69039,10)$zz$ORF @ 2217-2403" |
| | | CDS | complement(3021..3311)<br>/product="orf(0,279979,69039,11)$zz$Partial ORF @ 3020-3311" |
| | | CDS | complement(3065..3313)<br>/product="orf(0,279979,69039,12)$zz$Partial ORF @ 3064-3313" |
| 112 | 0315284_10088943<br>(Accession<br>0315284_10088943) | CDS | 2..259<br>/product="-> pfam00171(1,82)[90.4] | COG1012(1,85)[94.9] :A(7,281635,88942,3)$zz$succinate-semialdehydedehydrogenase/ glutarate-semialdehyde dehydrogenase &KO:K00135" |
| | | CDS | 2..256<br>/product="-> pfam00171(1,82)[90.4] | COG1012(1,85)[94.9] :orf(7,281635,88942,11)$zz$Partial ORF @ 3901-4156" |
| | | CDS | 343..756<br>/product="-> pfam01909(2,102)[41.6] | COG1708(1,134)[40.0]: A(7,281635,88942,2)$zz$hypothetical protein" |
| | | CDS | 740..1171<br>/product="-> pfam01934(7,135)[41.2] | COG2445(4,142)[53.9]: A(7,281635,88942,1)$zz$uncharacterized protein YutE(UPF0331/DUF86 family) & COG2445" |
| | | CDS | complement(805..1050)<br>/product="orf(7,281635,88942,9)$zz$ORF @ 3107-3353" |
| | | CDS | complement(983..1204)<br>/product="orf(7,281635,88942,8)$zz$ORF @ 2953-3175" |
| | | POI | 1326..4157<br>/product="-> IscB(1,61)[31.8] | IscB(347,451)[49.3] | cas9(401,456)[25.0] | KOON_cd09643(375,584)[29.9] | TIGR01865(372,584)[29.3] | pfam13395(405,452)[35.0] | pfam14239(1,77)[29.9] | COG1403(339,475)[25.7] :<br>A(7,281635,88942,0)$zz$5-methylcytosine-specific restriction endonuclease McrA & COG1403" |
| | | CDS | 1326..4157<br>/product="-> IscB(1,61)[31.8] | IscB(347,451)[49.3] | cas9(401,456)[25.0] | KOON_cd09643(375,584)[29.9] | TIGR01865(372,584)[29.3] | pfam13395(405,452)[35.0] | |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | | pfam14239(1,77)[29.9] \| COG1403(339,475)[25.7] : A(7,281635,88942,0)$zz$5-methylcytosine-specific restriction endonuclease McrA & COG1403" |
| | | CDS | complement(1346..1576) /product="orf(7,281635,88942,7)$zz$ORF @ 2581-2812" |
| | | CDS | complement(1515..1733) /product="orf(7,281635,88942,6)$zz$ORF @ 2424-2643" |
| | | CDS | 2440..2625 /product="orf(7,281635,88942,5)$zz$ORF @ 1532-1718" |
| | | CDS | complement(2505..2774) /product="orf(7,281635,88942,4)$zz$ORF @ 1383-1653" |
| | | CDS | complement(2931..3440) /product="orf(7,281635,88942,2)$zz$ORF @ 717-1227" |
| | | CDS | complement(3002..3301) /product="orf(7,281635,88942,3)$zz$ORF @ 856-1156" |
| | | CDS | complement(3498..3959) /product="orf(7,281635,88942,1)$zz$ORF @ 198-660" |
| 113 | 0172371_10009355 (Accession 0172371_10009355) | CDS | 3..443 /product="orf(16,31096,9354,49)$zz$Partial ORF @ 13048-13489" |
| | | CDS | 151..1239 /product="A(16,31096,9354,14)$zz$Multimeric flavodoxin WrbA/Putative sterol carrier protein & COG0655,COG3255" |
| | | CDS | complement(750..941) /product="orf(16,31096,9354,48)$zz$ORF @ 12550-12742" |
| | | CDS | complement(990..1208) /product="orf(16,31096,9354,47)$zz$ORF @ 12283-12502" |
| | | CDS | 1572..1841 /product="A(16,31096,9354,13)$zz$hypothetical protein & Hypo-rule applied" |
| | | CDS | complement(1784..2530) /product="orf(16,31096,9354,43)$zz$ORF @ 10961-11708" |
| | | CDS | complement(1861..2040) /product="orf(16,31096,9354,44)$zz$ORF @ 11451-11631" |
| | | CDS | 1871..3454 /product="A(16,31096,9354,12)$zz$Uncharacterized membrane protein YfcA & COG0730" |
| | | CDS | complement(2296..2562) /product="orf(16,31096,9354,42)$zz$ORF @ 10929-11196" |
| | | CDS | 2416..2856 /product="orf(16,31096,9354,40)$zz$ORF @ 10635-11076" |
| | | CDS | complement(2575..2832) /product="orf(16,31096,9354,41)$zz$ORF @ 10659-10917" |
| | | CDS | complement(2801..3055) /product="orf(16,31096,9354,39)$zz$ORF @ 10436-10691" |
| | | CDS | complement(3301..3519) /product="orf(16,31096,9354,37)$zz$ORF @ 9972-10191" |
| | | CDS | 3704..4162 /product="orf(16,31096,9354,36)$zz$ORF @ 9329-9788" |
| | | CDS | complement(3752..4243) /product="A(16,31096,9354,11)$zz$Protein of unknown function (DUF2442)/protein of unknown function (DUF4160) & pfam10387,pfam13711" |
| | | CDS | 4169..4396 /product="orf(16,31096,9354,34)$zz$ORF @ 9095-9323" |
| | | CDS | 4341..4652 /product="A(16,31096,9354,10)$zz$hypothetical protein & Hypo-rule applied" |
| | | CDS | complement(4422..4616) /product="orf(16,31096,9354,33)$zz$ORF @ 8875-9070" |
| | | POI | 4801..7647 /product="–> IscB(1,90)[33.7] \| IscB(348,448)[39.6] : A(16,31096,9354,9)$zz$RRXRR protein/HNH endonuclease & pfam14239,pfam13395" |
| | | CDS | 4801..7647 /product="–> IscB(1,90)[33.7] \| IscB(348,448)[39.6] : A(16,31096,9354,9)$zz$RRXRR protein/HNH endonuclease & pfam14239,pfam13395" |
| | | CDS | complement(4805..5137) /product="orf(16,31096,9354,31)$zz$ORF @ 8354-8687" |
| | | CDS | complement(6061..6246) /product="orf(16,31096,9354,30)$zz$ORF @ 7245-7431" |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | CDS | 6125..6304<br>/product="orf(16,31096,9354,29)$zz$ORF @ 7187-7367" |
| | CDS | complement(6505..6915)<br>/product="orf(16,31096,9354,28)$zz$ORF @ 6576-6987" |
| | CDS | complement(6915..7109)<br>/product="orf(16,31096,9354,27)$zz$ORF @ 6382-6577" |
| | CDS | complement(7258..7512)<br>/product="orf(16,31096,9354,26)$zz$ORF @ 5979-6234" |
| | CDS | complement(7491..7787)<br>/product="orf(16,31096,9354,24)$zz$ORF @ 5704-6001" |
| | DR | 7818..7853 |
| | DR | 7887..7922 |
| | CDS | 7910..8137<br>/product="orf(16,31096,9354,23)$zz$ORF @ 5354-5582" |
| | DR | 7958..7993 |
| | DR | 8027..8062 |
| | CDS | complement(8178..8429)<br>/product="A(16,31096,9354,8)$zz$hypothetical protein & Hypo-rule applied" |
| | CDS | complement(8519..8875)<br>/product="A(16,31096,9354,7)$zz$Uncharacterized conserved protein, contains HEPN domain & COG2361" |
| | CDS | complement(8865..9200)<br>/product="A(16,31096,9354,6)$zz$hypothetical protein & KO:K07075" |
| | CDS | complement(9256..9558)<br>/product="A(16,31096,9354,5)$zz$hypothetical protein & KO:K07075" |
| | CDS | 9693..10760<br>/product="orf(16,31096,9354,16)$zz$ORF @ 2731-3799" |
| | CDS | complement(9696..10778)<br>/product="orf(16,31096,9354,15)$zz$ORF @ 2713-3796" |
| | CDS | 9847..10281<br>/product="orf(16,31096,9354,18)$zz$ORF @ 3210-3645" |
| | CDS | complement(10442..10699)<br>/product="orf(16,31096,9354,17)$zz$ORF @ 2792-3050" |
| | CDS | 10576..10845<br>/product="orf(16,31096,9354,14)$zz$ORF @ 2646-2916" |
| | CDS | complement(10717..10899)<br>/product="orf(16,31096,9354,13)$zz$ORF @ 2592-2775" |
| | CDS | complement(10907..11149)<br>/product="orf(16,31096,9354,12)$zz$ORF @ 2342-2585" |
| | CDS | 11043..11492<br>/product="A(16,31096,9354,3)$zz$Nucleotide-binding universal stress protein, UspA family & COG0589" |
| | CDS | complement(11055..11270)<br>/product="orf(16,31096,9354,11)$zz$ORF @ 2221-2437" |
| | CDS | complement(11249..11563)<br>/product="orf(16,31096,9354,9)$zz$ORF @ 1928-2243" |
| | CDS | complement(11457..11657)<br>/product="orf(16,31096,9354,8)$zz$ORF @ 1834-2035" |
| | CDS | 11508..11963<br>/product="A(16,31096,9354,2)$zz$Bacterioferritin (cytochrome b1) & COG2193" |
| | CDS | complement(11654..11857)<br>/product="orf(16,31096,9354,7)$zz$ORF @ 1634-1838" |
| | CDS | 12056..12247<br>/product="orf(16,31096,9354,5)$zz$ORF @ 1244-1436" |
| | CDS | complement(12065..12883)<br>/product="A(16,31096,9354,1)$zz$Ubiquinone/menaquinone biosynthesis C-methylase UbiE & COG2226" |
| | CDS | 12342..12629<br>/product="orf(16,31096,9354,4)$zz$ORF @ 862-1150" |
| | CDS | 12521..12841<br>/product="orf(16,31096,9354,3)$zz$ORF @ 650-971" |
| | CDS | 13034..13489<br>/product="A(16,31096,9354,0)$zz$hypothetical protein & Hypo-rule applied" |
| | CDS | 13264..13491<br>/product="orf(16,31096,9354,0)$zz$Partial ORF @ 0-228" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| 114 | PWXP01000023.1 (Accession PWXP01000023 | CDS | complement(1..225)<br>/product="orf(1,245407,589,0)$zz$Partial ORF @ 0-225" |
| | | POI | 2..2971<br>/product="–> IscB(42,212)[26.8] \| IscB(394,494)[35.3] : orf(1,245407,589,1)$zz$Partial ORF @ 1-2971" |
| | | CDS | 2..2971<br>/product="–> IscB(42,212)[26.8] \| IscB(394,494)[35.3] : orf(1,245407,589,1)$zz$Partial ORF @ 1-2971" |
| | | CDS | complement(2..214)<br>/product="orf(1,245407,589,2)$zz$Partial ORF @ 1-214" |
| | | CDS | complement(269..1075)<br>/product="orf(1,245407,589,3)$zz$ORF @ 268-1075" |
| | | CDS | 381..722<br>/product="orf(1,245407,589,4)$zz$ORF @ 380-722" |
| | | CDS | complement(1012..1323)<br>/product="orf(1,245407,589,5)$zz$ORF @ 1011-1323" |
| | | CDS | complement(1758..2075)<br>/product="orf(1,245407,589,6)$zz$ORF @ 1757-2075" |
| | | CDS | complement(1799..2230)<br>/product="orf(1,245407,589,7)$zz$ORF @ 1798-2230" |
| | | CDS | 1851..2069<br>/product="orf(1,245407,589,8)$zz$ORF @ 1850-2069" |
| | | CDS | complement(2050..2286)<br>/product="orf(1,245407,589,9)$zz$ORF @ 2049-2286" |
| | | CDS | complement(2372..2749)<br>/product="orf(1,245407,589,10)$zz$ORF @ 2371-2749" |
| | | CDS | 3142..3657<br>/product="orf(1,245407,589,11)$zz$ORF @ 3141-3657" |
| | | CDS | complement(3159..3473)<br>/product="orf(1,245407,589,12)$zz$ORF @ 3158-3473" |
| | | CDS | complement(3481..3822)<br>/product="orf(1,245407,589,13)$zz$ORF @ 3480-3822" |
| | | CDS | complement(3773..4294)<br>/product="orf(1,245407,589,14)$zz$ORF @ 3772-4294" |
| | | CDS | 4146..4490<br>/product="orf(1,245407,589,15)$zz$ORF @ 4145-4490" |
| | | CDS | 4664..4981<br>/product="orf(1,245407,589,16)$zz$ORF @ 4663-4981" |
| | | CDS | complement(4737..5048)<br>/product="orf(1,245407,589,17)$zz$ORF @ 4736-5048" |
| | | CDS | 4981..5439<br>/product="orf(1,245407,589,18)$zz$ORF @ 4980-5439" |
| | | CDS | complement(5167..5430)<br>/product="orf(1,245407,589,19)$zz$ORF @ 5166-5430" |
| | | CDS | 5285..5584<br>/product="orf(1,245407,589,20)$zz$ORF @ 5284-5584" |
| | | CDS | complement(5488..6231)<br>/product="orf(1,245407,589,21)$zz$ORF @ 5487-6231" |
| | | CDS | 5686..6336<br>/product="orf(1,245407,589,22)$zz$ORF @ 5685-6336" |
| | | CDS | 6333..6797<br>/product="orf(1,245407,589,23)$zz$ORF @ 6332-6797" |
| | | CDS | 6370..6972<br>/product="orf(1,245407,589,24)$zz$ORF @ 6369-6972" |
| | | CDS | complement(6423..6626)<br>/product="orf(1,245407,589,25)$zz$ORF @ 6422-6626" |
| | | CDS | complement(6774..6995)<br>/product="orf(1,245407,589,26)$zz$ORF @ 6773-6995" |
| | | CDS | 6797..7369<br>/product="orf(1,245407,589,27)$zz$ORF @ 6796-7369" |
| | | CDS | complement(6812..7189)<br>/product="orf(1,245407,589,28)$zz$ORF @ 6811-7189" |
| | | CDS | 7158..7343<br>/product="orf(1,245407,589,29)$zz$ORF @ 7157-7343" |
| | | CDS | complement(7386..7661)<br>/product="orf(1,245407,589,30)$zz$ORF @ 7385-7661" |
| | | CDS | complement(7399..7686)<br>/product="orf(1,245407,589,31)$zz$ORF @ 7398-7686" |
| | | CDS | 7421..7801<br>/product="orf(1,245407,589,32)$zz$ORF @ 7420-7801" |
| | | CDS | 7447..7896<br>/product="orf(1,245407,589,33)$zz$ORF @ 7446-7896" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | 7548..8738<br>/product="orf(1,245407,589,34)$zz$ORF @ 7547-8738" |
| | | CDS | complement(7674..8654)<br>/product="orf(1,245407,589,35)$zz$ORF @ 7673-8654" |
| | | CDS | 8266..8673<br>/product="orf(1,245407,589,36)$zz$ORF @ 8265-8673" |
| | | CDS | 8660..8890<br>/product="orf(1,245407,589,37)$zz$ORF @ 8659-8890" |
| | | CDS | complement(8721..8939)<br>/product="orf(1,245407,589,38)$zz$ORF @ 8720-8939" |
| | | CDS | complement(8792..9139)<br>/product="orf(1,245407,589,39)$zz$ORF @ 8791-9139" |
| | | CDS | 8900..9517<br>/product="orf(1,245407,589,40)$zz$ORF @ 8899-9517" |
| | | CDS | complement(8926..9294)<br>/product="orf(1,245407,589,41)$zz$ORF @ 8925-9294" |
| | | CDS | 8938..9567<br>/product="orf(1,245407,589,42)$zz$ORF @ 8937-9567" |
| | | CDS | complement(9333..9626)<br>/product="orf(1,245407,589,43)$zz$ORF @ 9332-9626" |
| | | CDS | complement(9623..10333)<br>/product="orf(1,245407,589,44)$zz$ORF @ 9622-10333" |
| | | CDS | 9647..10522<br>/product="orf(1,245407,589,45)$zz$ORF @ 9646-10522" |
| | | CDS | complement(9775..10740)<br>/product="orf(1,245407,589,46)$zz$ORF @ 9774-10740" |
| | | CDS | 10658..11356<br>/product="orf(1,245407,589,47)$zz$ORF @ 10657-11356" |
| | | CDS | complement(10986..11732)<br>/product="orf(1,245407,589,48)$zz$ORF @ 10985-11732" |
| | | CDS | 11166..11786<br>/product="orf(1,245407,589,49)$zz$ORF @ 11165-11786" |
| | | CDS | complement(11180..11410)<br>/product="orf(1,245407,589,50)$zz$ORF @ 11179-11410" |
| | | CDS | 11221..11436<br>/product="orf(1,245407,589,51)$zz$ORF @ 11220-11436" |
| | | CDS | 11449..11661<br>/product="orf(1,245407,589,52)$zz$ORF @ 11448-11661" |
| 115 | 0265313_10000447 (Accession 0265313_10000447) | CDS | complement(420..623)<br>/product="orf(0,279806,446,103)$zz$ORF @ 26850-27054" |
| | | CDS | 523..750<br>/product="A(0,279806,446,20)$zz$hypothetical protein" |
| | | CDS | 905..1840<br>/product="A(0,279806,446,21)$zz$hypothetical protein" |
| | | CDS | complement(1061..1378)<br>/product="orf(0,279806,446,106)$zz$ORF @ 27491-27809" |
| | | CDS | 1170..1388<br>/product="orf(0,279806,446,107)$zz$ORF @ 27600-27819" |
| | | CDS | complement(1485..1925)<br>/product="orf(0,279806,446,108)$zz$ORF @ 27915-28356" |
| | | CDS | complement(1802..2074)<br>/product="orf(0,279806,446,109)$zz$ORF @ 28232-28505" |
| | | CDS | complement(1989..2750)<br>/product="orf(0,279806,446,110)$zz$ORF @ 28419-29181" |
| | | CDS | 2061..2747<br>/product="--> pfam00239(4,141)[100.9] \|<br>COG1961(2,221)[100.0] : A(0,279806,446,22)$zz$DNA invertase Pin-like site-specific DNA recombinase & COG1961" |
| | | CDS | complement(2189..2395)<br>/product="orf(0,279806,446,112)$zz$ORF @ 28619-28826" |
| | | CDS | complement(2597..3034)<br>/product="orf(0,279806,446,113)$zz$ORF @ 29027-29465" |
| | | CDS | complement(2959..3261)<br>/product="A(0,279806,446,23)$zz$hypothetical protein" |
| | | CDS | complement(3438..3746)<br>/product="A(0,279806,446,24)$zz$hypothetical protein" |
| | | CDS | complement(3806..4048)<br>/product="A(0,279806,446,25)$zz$hypothetical protein" |
| | | CDS | 3978..4145<br>/product="orf(0,279806,446,117)$zz$ORF @ 30408-30576" |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | CDS | complement(4048..4296) /product="A(0,279806,446,26)$zz$hypothetical protein" |
| | CDS | complement(4306..4485) /product="orf(0,279806,446,119)$zz$ORF @ 30736-30916" |
| | CDS | complement(4482..4649) /product="orf(0,279806,446,120)$zz$ORF @ 30912-31080" |
| | CDS | complement(4582..4962) /product="A(0,279806,446,27)$zz$hypothetical protein" |
| | CDS | 4937..5131 /product="orf(0,279806,446,122)$zz$ORF @ 31367-31562" |
| | CDS | 4977..5288 /product="orf(0,279806,446,123)$zz$ORF @ 31407-31719" |
| | CDS | complement(5034..5591) /product="A(0,279806,446,28)$zz$hypothetical protein" |
| | CDS | 5218..5997 /product="orf(0,279806,446,125)$zz$ORF @ 31648-32428" |
| | CDS | complement(5604..6893) /product="A(0,279806,446,29)$zz$hypothetical protein" |
| | CDS | complement(6560..6742) /product="orf(0,279806,446,127)$zz$ORF @ 32990-33173" |
| | CDS | 6730..7026 /product="orf(0,279806,446,128)$zz$ORF @ 33160-33457" |
| | CDS | complement(7139..7456) /product="orf(0,279806,446,129)$zz$ORF @ 33569-33887" |
| | CDS | 7237..7437 /product="orf(0,279806,446,130)$zz$ORF @ 33667-33868" |
| | CDS | 7570..7758 /product="orf(0,279806,446,131)$zz$ORF @ 34000-34189" |
| | CDS | 7769..8257 /product="orf(0,279806,446,132)$zz$ORF @ 34199-34688" |
| | DR | 7792..7828 |
| | CDS | 7843..8322 /product="orf(0,279806,446,133)$zz$ORF @ 34273-34753" |
| | DR | 7864..7895 |
| | DR | 7896..7941 |
| | CDS | 7938..8882 /product="orf(0,279806,446,134)$zz$ORF @ 34368-35313" |
| | DR | 7976..8012 |
| | DR | 8046..8082 |
| | DR | 8118..8154 |
| | DR | 8189..8225 |
| | DR | 8261..8297 |
| | DR | 8332..8368 |
| | DR | 8403..8439 |
| | DR | 8474..8510 |
| | DR | 8547..8583 |
| | DR | 8620..8656 |
| | DR | 8692..8728 |
| | DR | 8763..8799 |
| | DR | 8834..8870 |
| | CDS | 8903..9892 /product="orf(0,279806,446,135)$zz$ORF @ 35333-36323" |
| | DR | 8905..8941 |
| | DR | 8977..9013 |
| | DR | 9049..9085 |
| | CDS | 8903..9892 /product="orf(0,279806,446,135)$zz$ORF @ 35333-36323" |
| | DR | 9122..9158 |
| | DR | 9193..9229 |
| | DR | 9265..9301 |
| | DR | 9338..9374 |
| | CDS | 9391..9816 /product="orf(0,279806,446,137)$zz$ORF @ 35821-36247" |
| | DR | 9409..9445 |
| | DR | 9481..9517 |
| | DR | 9554..9590 |
| | DR | 9625..9661 |
| | DR | 9696..9732 |
| | DR | 9767..9803 |
| | CDS | complement(9832..10002) /product="orf(0,279806,446,138)$zz$ORF @ 36262-36433" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | POI | 10001..12817<br>/product="–> IscB(2,160)[29.3] \| IscB(378,449)[33.1] \| cas9(397,509)[29.0] \| KOON_cd09643(402,582)[30.4] \| TIGR01865(401,582)[32.5] \| pfam13395(406,452)[37.0] \| pfam14239(2,172)[29.8] : A(0,279806,446,30)$zz$HNH endonuclease/RRXRR protein & pfam13395,pfam14239" |
| | | CDS | 10001..12817<br>/product="–> IscB(2,160)[29.3] \| IscB(378,449)[33.1] \| cas9(397,509)[29.0] \| KOON_cd09643(402,582)[30.4] \| TIGR01865(401,582)[32.5] \| pfam13395(406,452)[37.0] \| pfam14239(2,172)[29.8] : A(0,279806,446,30)$zz$HNH endonuclease/RRXRR protein & pfam13395,pfam14239" |
| | | CDS | complement(10006..10227)<br>/product="orf(0,279806,446,140)$zz$ORF @ 36436-36658" |
| | | CDS | 10290..10625<br>/product="orf(0,279806,446,141)$zz$ORF @ 36720-37056" |
| | | CDS | 10492..10725<br>/product="orf(0,279806,446,142)$zz$ORF @ 36922-37156" |
| | | CDS | complement(10507..10722)<br>/product="orf(0,279806,446,143)$zz$ORF @ 36937-37153" |
| | | CDS | complement(11060..11977)<br>/product="orf(0,279806,446,144)$zz$ORF @ 37490-38408" |
| | | CDS | complement(11920..12096)<br>/product="orf(0,279806,446,145)$zz$ORF @ 38350-38527" |
| | | CDS | 11976..12281<br>/product="orf(0,279806,446,146)$zz$ORF @ 38406-38712" |
| | | CDS | 12291..12488<br>/product="orf(0,279806,446,147)$zz$ORF @ 38721-38919" |
| | | CDS | complement(12414..12626)<br>/product="orf(0,279806,446,148)$zz$ORF @ 38844-39057" |
| | | CDS | complement(12672..13262)<br>/product="orf(0,279806,446,149)$zz$ORF @ 39102-39693" |
| | | CDS | complement(12907..13416)<br>/product="A(0,279806,446,31)$zz$hypothetical protein" |
| | | CDS | 13025..13393<br>/product="orf(0,279806,446,151)$zz$ORF @ 39455-39824" |
| | | CDS | complement(13433..13747)<br>/product="orf(0,279806,446,152)$zz$ORF @ 39863-40178" |
| | | CDS | 13768..14010<br>/product="orf(0,279806,446,153)$zz$ORF @ 40198-40441" |
| | | CDS | complement(13940..14128)<br>/product="orf(0,279806,446,154)$zz$ORF @ 40370-40559" |
| | | CDS | 14257..14427<br>/product="orf(0,279806,446,155)$zz$ORF @ 40687-40858" |
| | | CDS | 14469..14816<br>/product="orf(0,279806,446,156)$zz$ORF @ 40899-41247" |
| | | CDS | complement(14546..14800)<br>/product="A(0,279806,446,32)$zz$hypothetical protein" |
| | | CDS | 14635..14883<br>/product="orf(0,279806,446,157)$zz$ORF @ 41065-41314" |
| | | CDS | complement(14733..14900)<br>/product="orf(0,279806,446,158)$zz$ORF @ 41163-41331" |
| | | CDS | complement(14813..15040)<br>/product="A(0,279806,446,33)$zz$hypothetical protein" |
| | | CDS | complement(15178..16125)<br>/product="A(0,279806,446,34)$zz$hypothetical protein" |
| | | CDS | complement(16181..16927)<br>/product="A(0,279806,446,35)$zz$hypothetical protein" |
| | | CDS | complement(16665..16850)<br>/product="orf(0,279806,446,162)$zz$ORF @ 43095-43281" |
| | | CDS | 16842..17180<br>/product="orf(0,279806,446,163)$zz$ORF @ 43272-43611" |
| 116 | 0123519_10012892<br>(Accession) | CDS | complement(3..209)<br>/product="orf(20,37532,12891,42)$zz$Partial ORF @ 11868-12075" |
| | | CDS | 134..394<br>/product="orf(20,37532,12891,41)$zz$ORF @ 11683-11944" |
| | | CDS | 262..486<br>/product="orf(20,37532,12891,40)$zz$ORF @ 11591-11816" |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | CDS | 545..745 /product="orf(20,37532,12891,39)$zz$ORF @ 11332-11533" |
| | CDS | 1118..1306 /product="orf(20,37532,12891,37)$zz$ORF @ 10771-10960" |
| | CDS | complement(1272..2759) /product="A(20,37532,12891,6)$zz$Signal transduction histidine kinase & COG0642" |
| | CDS | 1356..1736 /product="orf(20,37532,12891,36)$zz$ORF @ 10341-10722" |
| | CDS | 2164..2331 /product="orf(20,37532,12891,35)$zz$ORF @ 9746-9914" |
| | CDS | complement(2216..2584) /product="orf(20,37532,12891,34)$zz$ORF @ 9493-9862" |
| | CDS | 2331..2804 /product="orf(20,37532,12891,31)$zz$ORF @ 9273-9747" |
| | CDS | 2572..2769 /product="orf(20,37532,12891,32)$zz$ORF @ 9308-9506" |
| | CDS | complement(2977..3930) /product="orf(20,37532,12891,30)$zz$ORF @ 8147-9101" |
| | CDS | 3070..4752 /product="orf(20,37532,12891,26)$zz$ORF @ 7325-9008" |
| | CDS | complement(4285..4683) /product="orf(20,37532,12891,27)$zz$ORF @ 7394-7793" |
| | CDS | 4373..4621 /product="orf(20,37532,12891,28)$zz$ORF @ 7456-7705" |
| | CDS | 4425..4592 /product="orf(20,37532, 12891,29)$zz$ORF @ 7485-7653" |
| | CDS | 4889..5668 /product="A(20,37532,12891,4)$zz$PTS system, mannose-specific IID component & KO:K02796" |
| | CDS | complement(4913..5224) /product="orf(20,37532,12891,23)$zz$ORF @ 6853-7165" |
| | CDS | 4930..5145 /product="orf(20,37532,12891,25)$zz$ORF @ 6932-7148" |
| | CDS | complement(5017..5196) /product="orf(20,37532,12891,24)$zz$ORF @ 6881-7061" |
| | CDS | 5374..5679 /product="orf(20,37532,12891,21)$zz$ORF @ 6398-6704" |
| | CDS | complement(5661..5945) /product="orf(20,37532,12891,20)$zz$ORF @ 6132-6417" |
| | CDS | 5767..5979 /product="A(20,37532,12891,3)$zz$phosphocarrier protein & KO:K11189" |
| | CDS | complement(5946..6203) /product="orf(20,37532,12891,17)$zz$ORF @ 5874-6132" |
| | CDS | complement(5946..6203) /product="orf(20,37532,12891,17)$zz$ORF @ 5874-6132" |
| | CDS | complement(5965..6678) /product="orf(20,37532,12891,16)$zz$ORF @ 5399-6113" |
| | CDS | 5998..7791 /product="A(20,37532,12891,2)$zz$phosphotransferase system, enzyme I, PtsI & KO:K08483" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | 6018..6185 /product="orf(20,37532,12891,18)$zz$ORF @ 5892-6060" |
| | | CDS | complement(6889..7476) /product="orf(20,37532,12891,15)$zz$ORF @ 4601-5189" |
| | | CDS | complement(7500..7724) /product="orf(20,37532,12891,14)$zz$ORF @ 4353-4578" |
| | | CDS | complement(7624..7851) /product="orf(20,37532,12891,12)$zz$ORF @ 4226-4454" |
| | | CDS | 7791..7973 /product="orf(20,37532,12891,11)$zz$ORF @ 4104-4287" |
| | | CDS | 7801..8274 /product="A(20,37532,12891,1)$zz$SsrA-binding protein & KO:K03664" |
| | | CDS | complement(8133..8387) /product="orf(20,37532,12891,9)$zz$ORF @ 3690-3945" |
| | | CDS | complement(8524..8691) /product="orf(20,37532,12891,8)$zz$ORF @ 3386-3554" |
| | | POI | 8924..11773 /product="–> IscB(1,64)[32.3] | IscB(344,443)[43.8] : A(20,37532,12891,0)$zz$RRXRR protein/HNH endonuclease & pfam14239,pfam13395" |
| | | CDS | 8924..11773 /product="–> IscB(1,64)[32.3] | IscB(344,443)[43.8] : A(20,37532,12891,0)$zz$RRXRR protein/HNH endonuclease & pfam14239,pfam13395" CDS complement(8944..9171) |
| | | CDS | complement(8944..9171) /product="orf(20,37532,12891,7)$zz$ORF @ 2906-3134" |
| | | CDS | complement(9302..9694) /product="orf(20,37532,12891,6)$zz$ORF @ 2383-2776" |
| | | CDS | 10059..10268 /product="orf(20,37532,12891,5)$zz$ORF @ 1809-2019" |
| | | CDS | complement(10502..10846) /product="orf(20,37532, 12891,4)$zz$ORF @ 1231-1576" |
| | | CDS | complement(10985..11173) /product="orf(20,37532,12891,3)$zz$ORF @ 904-1093" |
| | | CDS | 11454..11654 /product="orf(20,37532,12891,2)$zz$ORF @ 423-624" |
| | | CDS | complement(11747..11917) /product="orf(20,37532, 12891,0)$zz$ORF @ 160-331" |
| | | DR | 11978..12003 |
| | | DR | 12051..12076 |
| 117 | 0315281_10148687 (accession 0315281_10148687) | CDS | complement(2..643) /product="–> pfam03819(34,107)[86.6] | pfam03819(167,213)[21.6] | COG3956(10,214)[207.0] : A(7,281632,148686,2)$zz$tetrapyrrole methylase family protein/MazG family protein/ATP diphosphatase & KO:K02499,KO:K04765" |
| | | CDS | 24..329 /product="orf(7,281632,148686,8)$zz$Partial ORF @ 2328-2634" |
| | | CDS | complement(85..330) /product="orf(7,281632,148686,7)$zz$ORF @ 2327-2573" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | complement(775..1305) /product="–> pfam02674(4,146)[99.7] \| COG1286(1,175)[94.0]: A(7,281632,148686,1)$zz$membrane protein required forcolicin V production & KO:K03558" |
| | | CDS | 1033..1257 /product="orf(7,281632,148686,5)$zz$ORF @ 1400-1625" |
| | | POI | 1492..2655 /product="–> IscB(4,159)[25.5] \| pfam14239(2,113)[27.2] : A(7,281632,148686,0)$zz$RRXRR protein & pfam14239" |
| | | CDS | 1492..2655 /product="–> IscB(4,159)[25.5] \| pfam14239(2,113)[27.2] : A(7,281632,148686,0)$zz$RRXRR protein & pfam14239" |
| | | CDS | 2072..2257 /product="orf(7,281632,148686,3)$zz$ORF @ 400-586" |
| | | CDS | complement(2450..2656) /product="orf(7,281632,148686,0)$zz$Partial ORF @ 1-208" |
| | | CDS | complement(2458..2655) /product="orf(7,281632,148686,1)$zz$Partial ORF @ 2-200" |
| | | ORIGIN | |
| 118 | 0209777_10000467 (Accession 0209777_10000467) | CDS | complement(259..1047) /product="orf(14,26210,466,179)$zz$ORF @ 59108-59897" |
| | | CDS | 371..877 /product="A(14,26210,466,63)$zz$hypothetical protein" |
| | | CDS | complement(711..905) /product="orf(14,26210,466,180)$zz$ORF @ 59250-59445" |
| | | CDS | complement(830..1063) /product="orf(14,26210,466,178)$zz$ORF @ 59092-59326" |
| | | CDS | complement(1106..1285) /product="orf(14,26210,466,177)$zz$ORF @ 58870-59050" |
| | | CDS | complement(1575..2864) /product="–> pfam00709(4,420)[591.4] \| COG0104(1,427)[616.9] : A(14,26210,466,62)$zz$adenylosuccinate synthase & KO:K01939" |
| | | CDS | 1803..2189 /product="orf(14,26210,466,176)$zz$ORF @ 57966-58353" |
| | | CDS | complement(2342..2521) /product="orf(14,26210,466,175)$zz$ORF @ 57634-57814" |
| | | CDS | complement(2938..4530) /product="–> pfam02826(110,284)[213.7] \| COG0111(2,325)[390.9] : A(14,26210,466,61)$zz$D-3-phosphoglycerate dehydrogenase & KO:K00058" |
| | | CDS | 3916..4182 /product="orf(14,26210,466,173)$zz$ORF @ 55973-56240" |
| | | CDS | 4207..4494 /product="orf(14,26210,466,172)$zz$ORF @ 55661-55949" |
| | | CDS | 4256..4579 /product="orf(14,26210,466,170)$zz$ORF @ 55576-55900" |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | CDS | complement(4641..5780) /product="–> pfam00266(4,348)[181.6] \| COG0075(1,379)[446.9] : A(14,26210,466,60)$zz$aspartate aminotransferase-like enzyme & COG0075" |
| | CDS | 4914..5561 /product="orf(14,26210,466,169)$zz$ORF @ 54594-55242" |
| | CDS | 6076..6330 /product="A(14,26210,466,59)$zz$hypothetical protein" |
| | CDS | complement(6309..6614) /product="orf(14,26210,466,165)$zz$ORF @ 53541-53847" |
| | CDS | 6330..7412 /product="–> pfam00557(141,344)[221.7] \| pfam01321(9,134)[87.6] \| COG0006(3,360)[334.0] : A(14,26210,466,58)$zz$Xaa-Pro aminopeptidase & KO:K01262" |
| | CDS | 6397..6573 /product="orf(14,26210,466,166)$zz$ORF @ 53582-53759" |
| | CDS | complement(6921..7199) /product="orf(14,26210,466,164)$zz$ORF @ 52956-53235" |
| | CDS | 6934..7206 /product="orf(14,26210,466,163)$zz$ORF @ 52949-53222" |
| | CDS | 7025..7234 /product="orf(14,26210,466,162)$zz$ORF @ 52921-53131" |
| | CDS | complement(7630..8799) /product="–> pfam00589(203,362)[129.2] \| COG0582(67,377)[116.0] : A(14,26210,466,57)$zz$integrase & COG0582" |
| | CDS | 7946..8161 /product="orf(14,26210,466,160)$zz$ORF @ 51994-52210" |
| | CDS | 9024..9305 /product=" A(14,26210,466,56)$zz$hypothetical protein" |
| | POI | 10001..12829 /product="–> IscB(1,69)[34.6] \| IscB(349,453)[40.2] \| pfam14239(1,79)[32.6] \| pfam13395(405,451)[23.7] : A(14,26210,466,55)$zz$RRXRR protein/HNH endonuclease & pfam14239,pfam13395" 10001..12829 /product="–> IscB(1,69)[34.6] \| IscB(349,453)[40.2] \| pfam14239(1,79)[32.6] \| pfam13395(405,451)[23.7] : A(14,26210,466,55)$zz$RRXRR protein/HNH endonuclease & pfam14239,pfam13395" 10560..10757 /product="orf(14,26210,466,157)$zz$ORF @ 49398-49596" complement(10603..10851) /product="orf(14,26210,466,156)$zz$ORF @ 49304-49553" complement(10697..11164) /product="orf(14,26210,466,155)$zz$ORF @ 48991-49459" complement(12792..12971) /product="orf(14,26210,466,153)$zz$ORF @ 47184-47364" |
| | DR | 13039..13070 |
| | DR | 13109..13140 |
| | DR | 13179..13210 |
| | DR | 13250..13281 |
| | DR | 13320..13351 |
| | DR | 13391..13422 |
| | CDS | 13968..14237 /product="A(14,26210,466,54)$zz$hypothetical protein" |
| | CDS | 14234..14662 /product="A(14,26210,466,53)$zz$hypothetical protein" |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | CDS | 14289..14516 /product="orf(14,26210,466,151)$zz$ORF @ 45639-45867" |
| | CDS | complement(14371..14778) /product="orf(14,26210,466,149)$zz$ORF @ 45377-45785" |
| | CDS | complement(14726..14986) /product="orf(14,26210,466,148)$zz$ORF @ 45169-45430" |
| | CDS | complement(15023..15286) /product="A(14,26210,466,52)$zz$hypothetical protein" |
| | CDS | 15360..15536 /product="orf(14,26210,466,146)$zz$ORF @ 44619-44796" |
| | CDS | complement(15407..15601) /product="A(14,26210,466,51)$zz$hypothetical protein" |
| | CDS | complement(15579..16346) /product="–> pfam07505(4,234)[281.0] \| COG4422(1,239)[293.8] : A(14,26210,466,50)$zz$protein gp37 & COG4422" |
| | CDS | 15661..15933 /product="orf(14,26210,466,144)$zz$ORF @ 44222-44495" |
| | CDS | complement(16177..16404) /product="orf(14,26210,466,142)$zz$ORF @ 43751-43979" |
| | CDS | complement(16576..16758) /product="orf(14,26210,466,141)$zz$ORF @ 43397-43580" |
| | CDS | 17074..17310 /product="orf(14,26210,466,140)$zz$ORF @ 42845-43082" |
| | CDS | 17165..17800 /product="A(14,26210,466,49)$zz$hypothetical protein" |
| | CDS | complement(17972..18145) /product="A(14,26210,466,48)$zz$hypothetical protein" |
| | CDS | complement(18156..19151) /product="–> pfam14559(125,188)[32.6] \| pfam13432(83,147)[32.4] \| COG0457(10,327)[77.2] : A(14,26210,466,47)$zz$tetratricopeptide (TPR) Repeat protein & COG0457" |
| | CDS | complement(18359..18556) /product="orf(14,26210,466,137)$zz$ORF @ 41599-41797" |
| | CDS | 18663..18836 /product="orf(14,26210,466,136)$zz$ORF @ 41319-41493" |
| | CDS | 18836..19021 /product="orf(14,26210,466,135)$zz$ORF @ 41134-41320" |
| | CDS | 19205..19462 /product="orf(14,26210,466,133)$zz$ORF @ 40693-40951" |
| | CDS | complement(19265..19870) /product="–> pfam00239(3,146)[151.4] \| COG1961(1,200)[149.0] : A(14,26210,466,46)$zz$DNA invertase Pin-like site-specific DNA recombinase & COG1961" |
| | CDS | 19269..19769 /product="orf(14,26210,466,132)$zz$ORF @ 40386-40887" |
| | CDS | complement(19946..20092) /product="A(14,26210,466,45)$zz$hypothetical protein" |
| | CDS | complement(20070..20306) /product="orf(14,26210,466,130)$zz$ORF @ 39849-40086" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | complement(20149..20271) /product="A(14,26210,466,44)$zz$hypothetical protein" |
| | | CDS | complement(20264..20356) /product="A(14,26210,466,43)$zz$hypothetical protein" |
| | | CDS | complement(20859..21848) /product="A(14,26210,466,42)$zz$hypothetical protein" |
| | | CDS | 21577..21774 /product="orf(14,26210,466,129)$zz$ORF @ 38381-38579" |
| | | CDS | 21936..22151 /product="orf(14,26210,466,127)$zz$ORF @ 38004-38220" |
| 119 | 0209017_10002254 (Accession 0209017_10002254) | CDS | 2..211 /product="orf(20,37423,2253,0)$zz$Partial ORF @ 1-211" |
| | | DR | 28..62 |
| | | DR | 94..128 |
| | | DR | 159..193 |
| | | CDS | complement(202..534) /product="orf(20,37423,2253,1)$zz$ORF @ 201-534" |
| | | DR | 225..259 |
| | | DR | 291..325 |
| | | CDS | 307..747 /product="orf(20,37423,2253,2)$zz$ORF @ 306-747" |
| | | DR | 357..391 |
| | | DR | 423..457 |
| | | DR | 489..523 |
| | | DR | 555..589 |
| | | DR | 620..654 |
| | | DR | 686..720 |
| | | CDS | 744..944 /product="orf(20,37423,2253,3)$zz$ORF @ 743-944" |
| | | DR | 752..786 |
| | | DR | 818..852 |
| | | DR | 884..918 |
| | | CDS | complement(890..1348) /product="orf(20,37423,2253,4)$zz$ORF @ 889-1348" |
| | | DR | 949..983 |
| | | CDS | 965..1426 /product="orf(20,37423,2253,5)$zz$ORF @ 964-1426" |
| | | DR | 1015..1049 |
| | | DR | 1081..1115 |
| | | POI | 1308..4538 /product="-> IscB(2,167)[28.2] ǀ IscB(412,517)[34.4] ǀ pfam14239(1,74)[31.3] ǀ pfam13395(471,515)[29.9] ǀ COG1403(434,534)[21.6] : A(20,37423,2253,0)$zz$5-methylcytosine-specific restriction endonuclease McrA & COG1403" |
| | | CDS | 1308..4538 /product="-> IscB(2,167)[28.2] ǀ IscB(412,517)[34.4] ǀ pfam14239(1,74)[31.3] ǀ pfam13395(471,515)[29.9] ǀ COG1403(434,534)[21.6] : A(20,37423,2253,0)$zz$5-methylcytosine-specific restriction endonuclease McrA & COG1403" |
| | | CDS | complement(1644..2609) /product="orf(20,37423,2253,7)$zz$ORF @ 1643-2609" |
| | | CDS | 2155..2508 /product="orf(20,37423,2253,8)$zz$ORF @ 2154-2508" |
| | | CDS | complement(2327..2545) /product="orf(20,37423,2253,9)$zz$ORF @ 2326-2545" |
| | | CDS | complement(2793..3581) /product="orf(20,37423,2253,10)$zz$ORF @ 2792-3581" |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | CDS | 2825..3028<br>/product="orf(20,37423,2253,11)$zz$ORF @ 2824-3028" |
| | CDS | complement(3179..3628)<br>/product="orf(20,37423,2253,12)$zz$ORF @ 3178-3628" |
| | CDS | complement(3633..4277)<br>/product="orf(20,37423,2253,13)$zz$ORF @ 3632-4277" |
| | CDS | complement(4142..4432)<br>/product="orf(20,37423,2253,14)$zz$ORF @ 4141-4432" |
| | CDS | complement(4189..4488)<br>/product="orf(20,37423,2253,15)$zz$ORF @ 4188-4488" |
| | CDS | 5032..5832<br>/product="A(20,37423,2253,1)$zz$hypothetical protein" |
| | CDS | 5088..5426<br>/product="orf(20,37423,2253,17)$zz$ORF @ 5087-5426" |
| | CDS | complement(5251..5844)<br>/product="orf(20,37423,2253,18)$zz$ORF @ 5250-5844" |
| | CDS | complement(5655..6071)<br>/product="orf(20,37423,2253,19)$zz$ORF @ 5654-6071" |
| | CDS | complement(5861..6046)<br>/product="orf(20,37423,2253,20)$zz$ORF @ 5860-6046" |
| | CDS | 5893..6081<br>/product="orf(20,37423,2253,21)$zz$ORF @ 5892-6081" |
| | CDS | complement(6013..6543)<br>/product="orf(20,37423,2253,23)$zz$ORF @ 6012-6543" |
| | CDS | 6101..6214<br>/product=" A(20,37423,2253,2)$zz$hypothetical protein" |
| | CDS | 6211..6852<br>/product="A(20,37423,2253,3)$zz$hypothetical protein" |
| | CDS | complement(6327..6530)<br>/product="orf(20,37423,2253,25)$zz$ORF @ 6326-6530" |
| | CDS | 6329..6526<br>/product="orf(20,37423,2253,26)$zz$ORF @ 6328-6526" |
| | CDS | 6849..7211<br>/product="orf(20,37423,2253,27)$zz$ORF @ 6848-7211" |
| | CDS | 6992..7387<br>/product="orf(20,37423,2253,28)$zz$ORF @ 6991-7387" |
| | CDS | complement(7306..7701)<br>/product="orf(20,37423,2253,29)$zz$ORF @ 7305-7701" |
| | CDS | 7403..8545 /product="–> pfam01380(50,183)[92.2] \| pfam00571(281,337)[40.7] \| COG0794(18,217)[220.5] \| COG2905(208,345)[47.0] : A(20,37423,2253,4)$zz$arabinose-5-phosphate isomerase & KO:K06041" |
| | CDS | 7696..8265<br>/product="orf(20,37423,2253,31)$zz$ORF @ 7695-8265" |
| | CDS | complement(7741..8385)<br>/product="orf(20,37423,2253,32)$zz$ORF @ 7740-8385" |
| | CDS | 7935..8171<br>/product="orf(20,37423,2253,33)$zz$ORF @ 7934-8171" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | 8559..8738 /product="orf(20,37423,2253,34)$zz$ORF @ 8558-8738" |
| | | CDS | 8566..8757 /product="orf(20,37423,2253,35)$zz$ORF @ 8565-8757" |
| | | CDS | complement(8617..8865) /product="orf(20,37423,2253,36)$zz$ORF @ 8616-8865" |
| | | CDS | 8871..12215 /product="A(20,37423,2253,5)$zz$hypothetical protein" |
| | | CDS | complement(9105..9917) /product="orf(20,37423,2253,38)$zz$ORF @ 9104-9917" |
| | | CDS | 9758..10126 /product="orf(20,37423,2253,39)$zz$ORF @ 9757-10126" |
| | | CDS | complement(10041..10892) /product="orf(20,37423,2253,40)$zz$ORF @ 10040-10892" |
| | | CDS | 10226..10660 /product="orf(20,37423,2253,41)$zz$ORF @ 10225-10660" |
| | | CDS | 10690..10971 /product="orf(20,37423,2253,42)$zz$ORF @ 10689-10971" |
| | | CDS | complement(10905..12320) /product="orf(20,37423,2253,43)$zz$ORF @ 10904-12320" |
| | | CDS | complement(10937..11758) /product="orf(20,37423,2253,44)$zz$ORF @ 10936-11758" |
| | | CDS | complement(11347..11553) /product="orf(20,37423,2253,45)$zz$ORF @ 11346-11553" |
| | | CDS | complement(11780..11968) /product="orf(20,37423,2253,46)$zz$ORF @ 11779-11968" |
| | | CDS | 12028..12198 /product="orf(20,37423,2253,47)$zz$ORF ( 12027-12198" |
| | | CDS | complement(12092..12286) /product="orf(20,37423,2253,48)$zz$ORF @ 12091-12286" |
| | | CDS | complement(12617..12799) /product="orf(20,37423,2253,49)$zz$Partial ORF @ 12616-12799" |
| 120 | TOLCLC_10013699 (Accession TOLCLC_10013699) | CDS | 2..196 /product="orf(14,27625,7029,41)$zz$Partial ORF @ 10989-11184" |
| | | CDS | 3..272 /product="orf(14,27625,7029,40)$zz$Partial ORF @ 10913-11183" |
| | | CDS | complement(42..296) /product="A(14,27625,7029,9)$zz$Protein of unknown function (DUF2007) & pfam09413" |
| | | CDS | complement(242..589) /product="orf(14,27625,7029,37)$zz$ORF @ 10596-10944" |
| | | CDS | 326..625 /product="A(14,27625,7029,8)$zz$Predicted RNAbinding protein containing KH domain, possibly ribosomal protein - COG1534 & COG1534" |
| | | CDS | complement(376..558) /product="orf(14,27625,7029,38)$zz$ORF @ 10627-10810" |
| | | CDS | complement(1156..1518) /product="orf(14,27625,7029,35)$zz$ORF @ 9667-10030" |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | POI | 1294..4158 /product="–> IscB(9,178)[25.5] \| IscB(359,460)[44.6] : A(14,27625,7029,7)$zz$HNH endonuclease & pfam01844" |
| | CDS | 1294..4158 /product="–> IscB(9,178)[25.5] \| IscB(359,460)[44.6] : A(14,27625,7029,7)$zz$HNH endonuclease & pfam01844" |
| | CDS | complement(1341..1544) /product="orf(14,27625,7029,33)$zz$ORF @ 9641-9845" |
| | CDS | 1343..1537 /product="orf(14,27625,7029,34)$zz$ORF @ 9648-9843" |
| | CDS | complement(1983..2174) /product="orf(14,27625,7029,32)$zz$ORF @ 9011-9203" |
| | CDS | 2225..2569 /product="orf(14,27625,7029,30)$zz$ORF @ 8616-8961" |
| | CDS | complement(2288..2497) /product="orf(14,27625,7029,31)$zz$ORF @ 8688-8898" |
| | CDS | complement(2721..2957) /product="orf(14,27625,7029,29)$zz$ORF @ 8228-8465" |
| | CDS | 2864..3118 /product="orf(14,27625,7029,28)$zz$ORF @ 8067-8322" |
| | CDS | complement(3136..3444) /product="orf(14,27625,7029,27)$zz$ORF @ 7741-8050" |
| | CDS | complement(3559..3732) /product="orf(14,27625,7029,26)$zz$ORF @ 7453-7627" |
| | CDS | complement(4118..4333) /product="orf(14,27625,7029,24)$zz$ORF @ 6852-7068" |
| | DR | 4356..4391 |
| | DR | 4426..4461 |
| | DR | 4496..4531 |
| | DR | 4566..4601 |
| | DR | 4636..4671 |
| | DR | 4706..4741 |
| | CDS | complement(4724..4894) /product="orf(14,27625,7029,23)$zz$ORF @ 6291-6462" |
| | CDS | 4758..4925 /product="orf(14,27625,7029,22)$zz$ORF @ 6260-6428" |
| | DR | 4776..4811 |
| | DR | 4845..4880 |
| | DR | 4915..4950 |
| | DR | 4984..5019 |
| | DR | 5054..5089 |
| | DR | 5124..5159 |
| | DR | 5193..5228 |
| | DR | 5251..5286 |
| | CDS | 5480..5872 /product="A(14,27625,7029,6)$zz$hypothetical protein" |
| | CDS | 5820..7154 /product="A(14,27625,7029,5)$zz$hypothetical protein" |
| | CDS | 6235..6459 /product="orf(14,27625,7029,20)$zz$ORF @ 4726-4951" |
| | CDS | 7154..7822 /product="A(14,27625,7029,4)$zz$hypothetical protein" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | complement(7202..7420) /product="orf(14,27625,7029,18)$zz$ORF @ 3765-3984" |
| | | CDS | complement(7996..8289) /product="orf(14,27625,7029,16)$zz$ORF @ 2896-3190" |
| | | CDS | complement(8305..8481) /product="orf(14,27625,7029,15)$zz$ORF @ 2704-2881" |
| | | CDS | 8451..9467 /product="orf(14,27625,7029,10)$zz$ORF @ 1718-2735" |
| | | CDS | complement(8558..8776) /product="orf(14,27625,7029,14)$zz$ORF @ 2409-2628" |
| | | CDS | complement(8691..9086) /product="orf(14,27625,7029,12)$zz$ORF @ 2099-2495" |
| | | CDS | complement(8786..9031) /product="orf(14,27625,7029,13)$zz$ORF @ 2154-2400" |
| | | CDS | 8986..9219 /product="orf(14,27625,7029,11)$zz$ORF @ 1966-2200" |
| | | CDS | complement(9314..9652) /product="orf(14,27625,7029,8)$zz$ORF @ 1533-1872" |
| | | CDS | 9337..9513 /product="orf(14,27625,7029,9)$zz$ORF @ 1672-1849" |
| | | CDS | 9464..9880 /product="A(14,27625,7029,2)$zz$hypothetical protein" |
| | | CDS | 9640..9840 /product="orf(14,27625,7029,7)$zz$ORF @ 1345-1546" |
| | | CDS | complement(9673..10329) /product="orf(14,27625,7029,4)$zz$ORF @ 856-1513" |
| | | CDS | 9877..10314 /product=" A(14,27625,7029,1)$zz$hypothetical protein" |
| | | CDS | complement(10157..10339) /product="orf(14,27625,7029,3)$zz$ORF @ 846-1029" |
| | | CDS | 10328..11185 /product="-> pfam01590(33,169)[90.8] \| pfam01590(200,285)[39.7] \| COG2203(16,170) [71.6] : A(14,27625,7029,0)$zz$FOG: GAF domain & COG2203" |
| | | CDS | complement(10681..11088) /product="orf(14,27625,7029,2)$zz$ORF @ 97-505" |
| | | CDS | complement(10769..11185) /product="orf(14,27625,7029,0)$zz$Partial ORF @ 0-417" |
| 121 | 0105107_10004396 (Accession 0105107_10004396) | CDS | /product="A(18,34121,4395,0)$zz$hypothetical protein & Hypo-rule applied" |
| | | CDS | 247..429 /product="A(18,34121,4395,1)$zz$Superinfection Immunity protein & pfam14373" |
| | | CDS | complement(364..546) /product="orf(18,34121,4395,2)$zz$ORF @ 363-546" |
| | | CDS | 375..581 /product="orf(18,34121,4395,3)$zz$ORF @ 374-581" |
| | | CDS | complement(578..745) /product="orf(18,34121,4395,4)$zz$ORF @ 577-745" |
| | | CDS | 593..1672 /product="A(18,34121,4395,2)$zz$hypothetical protein & Hypo-rule applied" |
| | | CDS | 2021..2194 /product="orf(18,34121,4395,7)$zz$ORF @ 2020-2194" |
| | | CDS | 2021..2194 /product="orf(18,34121,4395,7)$zz$ORF @ 2020-2194" |
| | | CDS | complement(2073..2255) /product="A(18,34121,4395,3)$zz$hypothetical protein & Hypo-rule applied" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | 2243..3934<br>/product="A(18,34121,4395,4)$zz$hypothetical protein & Hypo-rule applied" |
| | | CDS | 2382..2756<br>/product="orf(18,34121,4395,10)$zz$ORF @ 2381-2756" |
| | | CDS | complement(2444..2656)<br>/product="orf(18,34121,4395,11)$zz$ORF @ 2443-2656" |
| | | CDS | complement(2798..3010)<br>/product="orf(18,34121,4395,12)$zz$ORF @ 2797-3010" |
| | | CDS | complement(3216..3392)<br>/product="orf(18,34121,4395,13)$zz$ORF @ 3215-3392" |
| | | CDS | complement(3457..3648)<br>/product="orf(18,34121,4395,14)$zz$ORF @ 3456-3648" |
| | | CDS | 3526..3738<br>/product="orf(18,34121,4395,15)$zz$ORF @ 3525-3738" |
| | | CDS | 4392..5438<br>/product="A(18,34121,4395,5)$zz$Amidohydrolase & pfam04909" |
| | | CDS | 5977..8838 /product="-> IscB(2,65)[36.3] \| IscB(374,453) [35.9] : orf(18,34121,4395,17)$zz$ORF @ 5976-8838" |
| | | CDS | 5977..8838 /product="-> IscB(2,65)[36.3] \| IscB(374,453) [35.9] : orf(18,34121,4395, 17)$zz$ORF @ 5976-8838" |
| | | CDS | complement(6045..6827)<br>/product="orf(18,34121,4395,18)$zz$ORF @ 6044-6827" |
| | | CDS | complement(6364..6582)<br>/product="orf(18,34121,4395,19)$zz$ORF @ 6363-6582" |
| | | CDS | complement(6364..6582)<br>/product="orf(18,34121,4395,19)$zz$ORF @ 6363-6582" |
| | | CDS | 6527..6733<br>/product="orf(18,34121,4395,20)$zz$ORF @ 6526-6733" |
| | | CDS | complement(7160..7390)<br>/product="orf(18,34121,4395,21)$zz$ORF @ 7159-7390" |
| | | CDS | complement(7393..7722)<br>/product="orf(18,34121,4395,22)$zz$ORF @ 7392-7722" |
| | | CDS | complement(7936..8133)<br>/product="orf(18,34121,4395,23)$zz$ORF @ 7935-8133" |
| | | DR | 9027..9055 |
| | | DR | 9097..9125 |
| | | DR | 9168..9196 |
| | | CDS | complement(9278..9427)<br>/product="A(18,34121,4395,7)$zz$hypothetical protein &<br>Hypo-rule applied" |
| 122 | 0315274_10014677<br>(Accession<br>0315274_10014677) | CDS | complement(2..952)<br>/product="-> pfam13231(56,213)[52.1] :<br>A(7,281625,14676,9)$zz$dolichyl-phosphatemannose-protein<br>mannosyltransferase & pfam13231" |
| | | CDS | 2..196<br>/product="orf(7,281625,14676,24)$zz$Partial ORF @ 10905-11100" |
| | | CDS | 815..1039<br>/product="orf(7,281625,14676,22)$zz$ORF @ 10062-10287" |
| | | CDS | complement(1082..1582)<br>/product="orf(7,281625,14676,21)$zz$ORF @ 9519-10020" |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | CDS | 1118..2485 /product="–> pfam00171(1,452)[456.0] \| COG1012(1,455)[484.7] : A(7,281625,14676,8)$zz$succinate-semialdehyde dehydrogenase/glutarate-semialdehyde dehydrogenase & KO:K00135" |
| | CDS | 1398..1673 /product="orf(7,281625,14676,20)$zz$ORF @ 9428-9704" |
| | CDS | complement(1471..1884) /product="orf(7,281625,14676,19)$zz$ORF @ 9217-9631" |
| | CDS | 2569..2982 /product="–> pfam01909(2,102)[41.6] \| COG1708(1,134)[40.0]: A(7,281625,14676,7)$zz$hypothetical protein" |
| | CDS | 2966..3397 /product="–> pfam01934(7,135)[41.2] \| COG2445(4,142)[53.9]: A(7,281625,14676,6)$zz$uncharacterized protein YutE(UPF0331/DUF86 family) & COG2445" |
| | CDS | complement(3031..3276) /product="orf(7,281625,14676,16)$zz$ORF @ 7825-8071" |
| | CDS | complement(3209..3430) /product="orf(7,281625,14676,15)$zz$ORF @ 7671-7893" |
| | POI | 3552..6383 /product="–> IscB(1,61)[31.8] \| IscB(347,451) [49.3] \| cas9(401,456)[25.0] \| KOON_cd09643(375,584)[29.9] \| TIGR01865(372,584)[29.3] \| pfam13395(405,452) [35.0] \| pfam14239(1,77)[29.9] \| COG1403(339,475)[25.7] : A(7,281625,14676,5)$zz$5-methylcytosine-specific restriction endonuclease McrA & COG1403" |
| | | 3552..6383 /product="–> IscB(1,61)[31.8] \| IscB(347,451) [49.3] \| cas9(401,456)[25.0] \| KOON_cd09643(375,584)[29.9] \| TIGR01865(372,584)[29.3] \| pfam13395(405,452) [35.0] \| pfam14239(1,77)[29.9] \| COG1403(339,475)[25.7] : A(7,281625,14676,5)$zz$5-methylcytosine-specific restriction endonuclease McrA & COG1403" |
| | | complement(3572..3802) /product="orf(7,281625,14676,14)$zz$ORF @ 7299-7530" |
| | | complement(3741..3959) /product="orf(7,281625,14676,13)$zz$ORF @ 7142-7361" |
| | | 4666..4851 /product="orf(7,281625,14676,12)$zz$ORF @ 6250-6436" |
| | | complement(4731..5000) /product="orf(7,281625,14676,11)$zz$ORF @ 6101-6371" |
| | | complement(5157..5666) /product="orf(7,281625,14676,9)$zz$ORF @ 5435-5945" |
| | | complement(5228..5527) /product="orf(7,281625,14676,10)$zz$ORF @ 5574-5874" |
| | | complement(5724..6185) /product="orf(7,281625,14676,8)$zz$ORF @ 4916-5378" |
| | | complement(6440..6601) /product="A(7,281625,14676,4)$zz$hypothetical protein" |
| | DR | 6594..6630 |
| | DR | 6664..6700 |
| | DR | 6738..6774 |
| | DR | 6807..6843 |
| | DR | 6878..6914 |
| | DR | 6949..6985 |
| | CDS | 7223..8029 /product="A(7,281625,14676,3)$zz$hypothetical protein" |
| | CDS | complement(7929..8228) /product="orf(7,281625,14676,5)$zz$ORF @ 2873-3173" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | 8041..9048 /product="–> pfam01136(86,328)[112.4] \| COG0826(1,332)[93.9] : A(7,281625,14676,2)$zz$putative protease & KO:K08303" |
| | | CDS | 9155..10393 /product="–> pfam09825(19,123)[26.6] \| COG4285(15,123)[26.8] : A(7,281625,14676,1)$zz$glutamine amidotransferase-like uncharacterized protein & COG4285" |
| | | CDS | 9451..9621 /product="orf(7,281625,14676,3)$zz$ORF @ 1480-1651" |
| | | CDS | complement(9877..10074) /product="orf(7,281625,14676,2)$zz$ORF @ 1027-1225" |
| | | CDS | 10377..11099 /product="–> pfam02665(91,241)[36.7] \| COG2181(9,241)[43.9] : A(7,281625,14676,0)$zz$nitrate reductase gamma subunit & COG2181" |
| 123 | 0180435_10002165 (Accession 0180435_10002165) | CDS | 103..684 /product="A(18,35203,2164,0)$zz$hypothetical protein & Hypo-rule applied" |
| | | CDS | complement(121..327) /product="orf(18,35203,2164,1)$zz$ORF @ 120-327" |
| | | CDS | complement(394..636) /product="orf(18,35203,2164,2)$zz$ORF @ 393-636" |
| | | CDS | 807..2579 /product="–> pfam10412(158,332)[35.1] \| COG3505(364,521)[20.8] : A(18,35203,2164,1)$zz$Type IV secretory pathway, VirD4 component, TraG/TraD family ATPase & COG3505" |
| | | CDS | complement(2226..2402) /product="orf(18,35203,2164,4)$zz$ORF @ 2225-2402" |
| | | CDS | 2563..3264 /product=" A(18,35203,2164,2)$zz$hypothetical protein & Hypo-rule applied" |
| | | CDS | 3284..4267 /product="–> KOON_COG4951(37,199)[92.0] \| PrimPol(7,203)[64.0] \| COG4951(25,224)[92.2] : A(18,35203,2164,3)$zz$hypothetical protein & COG4951" |
| | | CDS | complement(4253..4468) /product="orf(18,35203,2164,7)$zz$ORF @ 4252-4468" |
| | | CDS | 4287..4664 /product="orf(18,35203,2164,8)$zz$ORF @ 4286-4664" |
| | | CDS | complement(4455..4631) /product="orf(18,35203,2164,9)$zz$ORF @ 4454-4631" |
| | | CDS | 4459..5727 /product="–> pfam00589(164,332)[76.4] \| COG0582(48,349)[86.5] : A(18,35203,2164,4)$zz$Integrase & COG0582" |
| | | CDS | complement(5436..5606) /product="orf(18,35203,2164,11)$zz$ORF @ 5435-5606" |
| | | CDS | 5970..6140 /product="orf(18,35203,2164,12)$zz$ORF @ 5969-6140" |
| | | CDS | 6128..6433 /product="orf(18,35203,2164,13)$zz$ORF @ 6127-6433" |
| | | CDS | 6142..7431 /product="–> pfam00589(229,401)[102.1] \| pfam14659(118,177)[30.0] \| COG0582(90,417) [103.2] : A(18,35203,2164,5)$zz$Integrase & COG0582" |
| | | CDS | 6644..6862 /product="orf(18,35203,2164,15)$zz$ORF @ 6643-6862" |
| | | CDS | 6726..6968 /product="orf(18,35203,2164,16)$zz$ORF @ 6725-6968" |
| | | CDS | complement(6907..7221) /product="orf(18,35203,2164,17)$zz$ORF @ 6906-7221" |
| | | CDS | 7418..8050 /product=" A(18,35203,2164,6)$zz$hypothetical protein & Hypo-rule applied" |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | CDS | complement(8112..8552) /product="–> pfam02556(15,143)[41.5] \| COG1952(3,144)[51.3] : A(18,35203,2164,7)$zz$preprotein translocase subunit SecB & KO:K03071" |
| | CDS | complement(8557..8955) /product=" A(18,35203,2164,8)$zz$hypothetical protein & Hypo-rule applied" |
| | CDS | complement(8958..9479) /product=" A(18,35203,2164,9)$zz$hypothetical protein & Hypo-rule applied" |
| | CDS | 9354..9524 /product="orf(18,35203,2164,22)$zz$ORF @ 9353-9524" |
| | POI | 9927..12782 /product="–> IscB(3,168)[33.2] \| IscB(348,445) [40.3] \| pfam14239(1,85)[31.9] \| pfam01844(406,449) [24.0] : A(18,35203,2164,10)$zz$RRXRR protein/HNH endonuclease & pfam14239,pfam01844" |
| | CDS | 9927..12782 /product="–> IscB(3,168)[33.2] \| IscB(348,445) [40.3] \| pfam14239(1,85)[31.9] \| pfam01844(406,449) [24.0] : A(18,35203,2164,10)$zz$RRXRR protein/HNH endonuclease & pfam14239,pfam01844" |
| | CDS | 10141..10308 /product="orf(18,35203,2164,24)$zz$ORF @ 10140-10308" |
| | CDS | complement(10841..11008) /product="orf(18,35203,2164,25)$zz$ORF @ 10840-11008" |
| | CDS | complement(10899..11165) /product="orf(18,35203,2164,26)$zz$ORF @ 10898-11165" |
| | CDS | complement(11098..11319) /product="orf(18,35203,2164,27)$zz$ORF @ 11097-11319" |
| | CDS | complement(12383..12583) /product="orf(18,35203,2164,28)$zz$ORF @ 12382-12583" |
| | DR | 12942..12973 |
| | CDS | 12985..13311 /product="orf(18,35203,2164,29)$zz$ORF @ 12984-13311" |
| | DR | 13009..13040 |
| | CDS | 13043..13390 /product="orf(18,35203,2164,30)$zz$ORF @ 13042-13390" |
| | DR | 13074..13105 |
| | DR | 13140..13171 |
| | DR | 13206..13237 |
| | DR | 13273..13304 |
| | CDS | 13318..13539 /product="orf(18,35203,2164,31)$zz$ORF @ 13317-13539" |
| | CDS | 13332..13598 /product="orf(18,35203,2164,32)$zz$ORF @ 13331-13598" |
| | DR | 13340..13371 |
| | DR | 13407..13438 |
| | DR | 13475..13506 |
| | DR | 13540..13571 |
| | CDS | 13975..14229 /product="A(18,35203,2164,11)$zz$hypothetical protein & Hypo-rule applied" |
| | CDS | complement(14089..14370) /product="orf(18,35203,2164,34)$zz$ORF @ 14088-14370" |
| | CDS | 14207..14509 /product="A(18,35203,2164,12)$zz$hypothetical protein & Hypo-rule applied" |
| | CDS | 14512..14880 /product="A(18,35203,2164,13)$zz$hypothetical protein & Hypo-rule applied" |
| | CDS | 14639..14941 /product="orf(18,35203,2164,37)$zz$ORF @ 14638-14941" |
| | CDS | complement(14686..14883) /product="orf(18,35203,2164,38)$zz$ORF @ 14685-14883" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | 15040..15252 /product="A(18,35203,2164,14)$zz$hypothetical protein & Hypo-rule applied" |
| | | CDS | 15266..15478 /product="A(18,35203,2164,15)$zz$hypothetical protein & Hypo-rule applied" |
| | | CDS | complement(15381..15647) /product="orf(18,35203,2164,41)$zz$ORF @ 15380-15647" |
| | | CDS | 15570..16220 /product="A(18,35203,2164,16)$zz$hypothetical protein & Hypo-rule applied" |
| | | CDS | complement(16082..16369) /product="orf(18,35203,2164,43)$zz$ORF @ 16081-16369" |
| | | CDS | 16239..16688 /product="A(18,35203,2164,17)$zz$hypothetical protein & Hypo-rule applied" |
| | | CDS | complement(16270..16539) /product="orf(18,35203,2164,45)$zz$ORF @ 16269-16539" |
| | | CDS | 16685..16882 /product="A(18,35203,2164,18)$zz$hypothetical protein & Hypo-rule applied" |
| | | CDS | 16995..17240 /product="A(18,35203,2164,19)$zz$hypothetical protein & Hypo-rule applied" |
| | | CDS | complement(17091..17312) /product="orf(18,35203,2164,47)$zz$ORF @ 17090-17312" |
| | | CDS | 17233..17397 /product="A(18,35203,2164,20)$zz$hypothetical protein & Hypo-rule applied" |
| | | CDS | 17397..18116 /product="A(18,35203,2164,21)$zz$hypothetical protein & Hypo-rule applied" |
| | | CDS | complement(17469..17747) /product="orf(18,35203,2164,50)$zz$ORF @ 17468-17747" |
| | | CDS | complement(18006..18215) /product="orf(18,35203,2164,51)$zz$ORF @ 18005-18215" |
| | | CDS | complement(18167..18322) /product="A(18,35203,2164,22)$zz$hypothetical protein & Hypo-rule applied" |
| | | CDS | complement(18623..19369) /product="--> pfam04452(16,240)[213.3] \| COG1385(1,244)[218.8] : A(18,35203,2164,23)$zz$16S rRNA (uracil1498-N3)-methyltransferase & KO:K09761" |
| | | CDS | 18864..19142 /product="orf(18,35203,2164,53)$zz$ORF @ 18863-19142" |
| | | CDS | complement(19090..19263) /product="orf(18,35203,2164,54)$zz$ORF @ 19089-19263" |
| | | CDS | 19182..19472 /product="orf(18,35203,2164,55)$zz$ORF @ 19181-19472" |
| | | CDS | 19232..19426 /product="orf(18,35203,2164,56)$zz$ORF @ 19231-19426" |
| | | CDS | complement(19683..19868) /product="orf(18,35203,2164,57)$zz$ORF @ 19682-19868" |
| | | CDS | 19714..20178 /product="A(18,35203,2164,24)$zz$hypothetical protein & Hypo-rule applied" |
| 124 | 0172370__10020008 (Accession 0172370__10020008) | CDS | 2..493 /product="orf(16,31122,20007,0)$zz$Partial ORF @ 1-493" |
| | | CDS | 2..496 /product=" A(16,31122,20007,0)$zz$hypothetical protein & Hypo-rule applied" |
| | | CDS | complement(2..220) /product="orf(16,31122,20007,1)$zz$Partial ORF @ 1-220" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | complement(224..478) /product="orf(16,31122,20007,2)$zz$ORF @ 223-478" |
| | | CDS | complement(403..579) /product="orf(16,31122,20007,3)$zz$ORF @ 402-579" |
| | | CDS | 512..835 /product="A(16,31122,20007,1)$zz$hypothetical protein & Hypo-rule applied" |
| | | CDS | 738..1058 /product="orf(16,31122,20007,5)$zz$ORF @ 737-1058" |
| | | CDS | 841..1170 /product="orf(16,31122,20007,6)$zz$ORF @ 840-1170" |
| | | CDS | complement(882..1907) /product="A(16,31122,20007,2)$zz$L-iditol 2-Dehydrogenase & KO:K00008" |
| | | CDS | 1617..1916 /product="orf(16,31122,20007,8)$zz$ORF @ 1616-1916" |
| | | CDS | 1955..2161 /product="A(16,31122,20007,3)$zz$hypothetical protein & Hypo-rule applied" |
| | | CDS | 2175..2267 /product="A(16,31122,20007,4)$zz$hypothetical protein & Hypo-rule applied" |
| | | POI | 2270..5326 /product="–> cas9(438,989)[28.0] \| IscB(395,507) [57.7] : A(16,31122,20007,5)$zz$5-methylcytosine-specific restriction endonuclease McrA & COG1403" |
| | | CDS | 2270..5326 /product="–> cas9(438,989)[28.0] \| IscB(395,507) [57.7] : A(16,31122,20007,5)$zz$5-methylcytosine-specific restriction endonuclease McrA & COG1403" |
| | | CDS | complement(2356..2529) /product="orf(16,31122,20007,11)$zz$ORF @ 2355-2529" |
| | | CDS | complement(4076..4306) /product="orf(16,31122,20007,12)$zz$ORF @ 4075-4306" |
| | | CDS | complement(4718..4897) /product="orf(16,31122,20007,13)$zz$ORF @ 4717-4897" |
| | | DR | 568..5603 |
| | | DR | 5642..5677 |
| | | DR | 5715..5750 |
| | | DR | 5787..5822 |
| | | DR | 5858..5893 |
| | | DR | 5931..5966 |
| | | DR | 6002..6037 |
| | | CDS | /product="A(16,31122,20007,6)$zz$hypothetical protein & Hypo-rule applied" |
| | | CDS | 6351..6524 /product="orf(16,31122,20007,15)$zz$ORF @ 6350-6524" |
| | | CDS | complement(6532..6675) /product="A(16,31122,20007,7)$zz$hypothetical protein & Hypo-rule applied" |
| 125 | OQUW01001492.1 (Accession OQUW01001492) | CDS | 7..41 |
| | | CDS | 73..107 |
| | | CDS | 138..172 |
| | | CDS | 204..238 |
| | | CDS | 270..304 |
| | | CDS | 326..514 /product="orf(5,10156,1491,0)$zz$ORF @ 325-514" |
| | | CDS | 336..370 |
| | | CDS | 402..436 |
| | | CDS | 418..654 /product="orf(5,10156,1491,1)$zz$ORF @ 417-654" |
| | | CDS | 468..502 |
| | | CDS | 534..568 |
| | | CDS | 600..634 |
| | | DR | 666..700 |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | CDS | 682..861 /product="orf(5,10156,1491,2)$zz$ORF @ 681-861" |
| | DR | 732..766 |
| | DR | 798..832 |
| | DR | 863..897 |
| | DR | 907..1212 |
| | CDS | /product="orf(5,10156,1491,3)$zz$ORF @ 906-1212" |
| | DR | 929..963 |
| | DR | 995..1029 |
| | CDS | 1154..1345 /product="orf(5,10156,1491,4)$zz$ORF @ 1153-1345" |
| | POI | 1227..4403 /product="-> IscB(2,174)[26.8] | IscB(407,514) [35.5] : orf(5,10156,1491,5)$zz$ORF @ 1226-4403" |
| | CDS | 1227..4403 /product="-> IscB(2,174)[26.8] | IscB(407,514) [35.5] : orf(5,10156,1491,5)$zz$ORF @ 1226-4403" |
| | CDS | 1823..2005 /product="orf(5,10156,1491,6)$zz$ORF @ 1822-2005" |
| | CDS | complement(1851..2642) /product="orf(5,10156,1491,7)$zz$ORF @ 1850-2642" |
| | CDS | complement(2231..2449) /product="orf(5,10156,1491,8)$zz$ORF @ 2230-2449" |
| | CDS | 2239..2412 /product="orf(5,10156,1491,9)$zz$ORF @ 2238-2412" |
| | CDS | complement(2500..2700) /product="orf(5,10156,1491,10)$zz$ORF @ 2499-2700" |
| | CDS | complement(2570..2779) /product="orf(5,10156,1491,11)$zz$ORF @ 2569-2779" |
| | CDS | complement(2697..3128) /product="orf(5,10156,1491,12)$zz$ORF @ 2696-3128" |
| | CDS | complement(2837..3535) /product="orf(5,10156,1491,13)$zz$ORF @ 2836-3535" |
| | CDS | 3283..3543 /product="orf(5,10156,1491,14)$zz$ORF @ 3282-3543" |
| | CDS | complement(3540..4463) /product="orf(5,10156,1491,15)$zz$ORF @ 3539-4463" |
| | CDS | 3818..4432 /product="orf(5,10156,1491,16)$zz$ORF @ 3817-4432" |
| | CDS | complement(3985..4353) /product="orf(5,10156,1491,17)$zz$ORF @ 3984-4353" |
| | CDS | complement(4007..4297) /product="orf(5,10156,1491,18)$zz$ORF @ 4006-4297" |
| | CDS | complement(4490..4855) /product="orf(5,10156,1491,19)$zz$ORF @ 4489-4855" |
| | CDS | 4613..5230 /product="orf(5,10156,1491,20)$zz$ORF @ 4612-5230" |
| | CDS | 4780..4956 /product="orf(5,10156,1491,21)$zz$ORF @ 4779-4956" |
| | CDS | complement(4963..5460) /product="orf(5,10156,1491,22)$zz$ORF @ 4962-5460" |
| | CDS | 5197..6339 /product="orf(5,10156,1491,23)$zz$ORF @ 5196-6339" |
| | CDS | complement(5358..5714) /product="orf(5,10156,1491,24)$zz$ORF @ 5357-5714" |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | CDS | complement(5551..6069)<br>/product="orf(5,10156,1491,25)$zz$ORF @ 5550-6069" |
| | CDS | 5729..5965<br>/product="orf(5,10156,1491,26)$zz$ORF @ 5728-5965" |
| | CDS | complement(5790..6101)<br>/product="orf(5,10156,1491,27)$zz$ORF @ 5789-6101" |
| | CDS | 6323..6520<br>/product="orf(5,10156,1491,28)$zz$ORF @ 6322-6520" |
| | CDS | 6360..6551<br>/product="orf(5,10156,1491,29)$zz$ORF @ 6359-6551" |
| | CDS | 6548..10150<br>/product="orf(5,10156,1491,30)$zz$ORF @ 6547-10150" |
| | CDS | 6598..7536<br>/product="orf(5,10156,1491,31)$zz$ORF @ 6597-7536" |
| | CDS | complement(6851..7570)<br>/product="orf(5,10156,1491,32)$zz$ORF @ 6850-7570" |
| | CDS | complement(7279..7560)<br>/product="orf(5,10156,1491,33)$zz$ORF @ 7278-7560" |
| | CDS | complement(7601..10312)<br>/product="orf(5,10156,1491,34)$zz$ORF @ 7600-10312" |
| | CDS | 8607..8897<br>/product="orf(5,10156,1491,35)$zz$ORF @ 8606-8897" |
| | CDS | complement(8872..9534)<br>/product="orf(5,10156,1491,36)$zz$ORF @ 8871-9534" |
| | CDS | 9115..9780<br>/product="orf(5,10156,1491,37)$zz$ORF @ 9114-9780" |
| | CDS | complement(9282..9488)<br>/product="orf(5,10156,1491,38)$zz$ORF @ 9281-9488" |
| | CDS | complement(9510..9707)<br>/product="orf(5,10156,1491,39)$zz$ORF @ 9509-9707" |
| | CDS | complement(9715..9903)<br>/product="orf(5,10156,1491,40)$zz$ORF @ 9714-9903" |
| | CDS | 9963..10133<br>/product="orf(5,10156,1491,41)$zz$ORF @ 9962-10133" |
| | CDS | complement(10557..10826)<br>/product="orf(5,10156,1491,42)$zz$ORF @ 10556-10826" |
| | CDS | 10786..11307<br>/product="orf(5,10156,1491,43)$zz$ORF @ 10785-11307" |
| | CDS | complement(10795..11415)<br>/product="orf(5,10156,1491,44)$zz$ORF @ 10794-11415" |
| | CDS | 10955..11122<br>/product="orf(5,10156,1491,45)$zz$ORF @ 10954-11122" |
| | CDS | complement(11183..11506)<br>/product="orf(5,10156,1491,46)$zz$ORF @ 11182-11506" |
| | CDS | 11346..12485<br>/product="orf(5,10156,1491,47)$zz$ORF @ 11345-12485" |
| | CDS | complement(11556..12452)<br>/product="orf(5,10156,1491,48)$zz$ORF @ 11555-12452" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | complement(11857..12111) /product="orf(5,10156,1491,49)$zz$ORF @ 11856-12111" |
| | | CDS | 12040..13371 /product="orf(5,10156,1491,50)$zz$ORF @ 12039-13371" |
| | | CDS | complement(12283..12495) /product="orf(5,10156,1491,51)$zz$ORF @ 12282-12495" |
| | | CDS | complement(12329..13555) /product="orf(5,10156,1491,52)$zz$ORF @ 12328-13555" |
| | | CDS | 12482..13576 /product="orf(5,10156,1491,53)$zz$ORF @ 12481-13576" |
| | | CDS | complement(12504..12689) /product="orf(5,10156,1491,54)$zz$ORF @ 12503-12689" |
| | | CDS | complement(12574..12849) /product="orf(5,10156,1491,55)$zz$ORF @ 12573-12849" |
| | | CDS | complement(13089..13337) /product="orf(5,10156,1491,56)$zz$ORF @ 13088-13337" |
| | | CDS | 13161..13409 /product="orf(5,10156,1491,57)$zz$ORF @ 13160-13409" |
| | | CDS | 13691..13930 /product="orf(5,10156,1491,58)$zz$ORF @ 13690-13930" |
| | | CDS | 14141..14362 /product="orf(5,10156,1491,63)$zz$ORF @ 14140-14362" |
| 126 | a0068712_1010247 (Accession a0068712_1010247) | CDS | complement(20..1039) /product="A(17,32320,10246,3)$zz$Transposase and inactivated derivatives & COG3547" |
| | | CDS | 177..434 /product="orf(17,32320,10246,16)$zz$ORF @ 5521-5779" |
| | | CDS | 495..890 /product="orf(17,32320,10246,15)$zz$ORF @ 5065-5461" |
| | | CDS | 917..1237 /product="orf(17,32320,10246,11)$zz$ORF @ 4718-5039" |
| | | CDS | 942..1121 /product="orf(17,32320, 10246,13)$zz$ORF @ 4834-5014" |
| | | CDS | complement(967..1224) /product="orf(17,32320,10246,12)$zz$ORF @ 4731-4989" |
| | | CDS | complement(1221..1439) /product="orf(17,32320,10246,10)$zz$ORF @ 4516-4735" |
| | | CDS | complement(1234..1563) /product="orf(17,32320,10246,9)$zz$ORF @ 4392-4722" |
| | | POI | 1597..4407 /product="–> IscB(2,69)[28.0] | IscB(342,437) [29.7] : A(17,32320,10246,2)$zz$hypothetical protein" |
| | | CDS | 1597..4407 /product="–> IscB(2,69)[28.0] | IscB(342,437) [29.7] : A(17,32320,10246,2)$zz$hypothetical protein" |
| | | CDS | 2115..2462 /product="orf(17,32320, 10246,7)$zz$ORF @ 3493-3841" |
| | | CDS | complement(2190..2417) /product="orf(17,32320, 10246,8)$zz$ORF @ 3538-3766" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | complement(2332..3114) /product="orf(17,32320,10246,5)$zz$ORF @ 2841-3624" |
| | | CDS | 2738..3055 /product="orf(17,32320,10246,6)$zz$ORF @ 2900-3218" |
| | | CDS | complement(3553..3987) /product="orf(17,32320,10246,4)$zz$ORF @ 1968-2403" |
| | | CDS | complement(4099..4566) /product="orf(17,32320,10246,2)$zz$ORF @ 1389-1857" |
| | | DR | 4591..4626 |
| | | DR | 4661..4696 |
| | | DR | 4733..4768 |
| | | DR | 4804..4839 |
| | | DR | 4875..4910 |
| | | DR | 4945..4980 |
| | | DR | 5015..5050 |
| | | DR | 5086..5121 |
| | | CDS | complement(5394..5579) /product="orf(17,32320,10246,1)$zz$ORF @ 376-562" |
| | | CDS | 5478..5672 /product="A(17,32320,10246,1)$zz$hypothetical protein" |
| | | CDS | 5780..5954 /product="A(17,32320,10246,0)$zz$hypothetical protein" |
| 127 | 0180431_10019360 (Accession 0180431_10019360) | CDS | complement(272..655) /product="-> pfam01934(7,118)[55.2] \| COG2361(7,126)[61.6]: A(18,35204,19359,6)$zz$Uncharacterized conserved protein, contains HEPN domain & COG2361" |
| | | CDS | complement(648..953) /product="-> pfam01909(11,101)[43.3] \| COG1669(4,101)[56.2] : A(18,35204,19359,5)$zz$hypothetical protein & KO:K07075" |
| | | CDS | 902..1456 /product="orf(18,35204,19359,22)$zz$ORF @ 5536-6091" |
| | | CDS | 978..1226 /product="A(18,35204,19359,4)$zz$hypothetical protein & Hypo-rule applied" |
| | | CDS | complement(1098..1397) /product="A(18,35204,19359,3)$zz$hypothetical protein & Hypo-rule applied" CDS complement(1271..1522) |
| | | CDS | complement(1271..1522) /product="orf(18,35204,19359,21)$zz$ORF @ 5470-5722" |
| | | CDS | 1330..1827 /product="orf(18,35204,19359,20)$zz$ORF @ 5165-5663" |
| | | CDS | 1703..1939 /product="orf(18,35204,19359,19)$zz$ORF @ 5053-5290" |
| | | DR | 1755..1789 |
| | | DR | 1821..1855 |
| | | DR | 1887..1921 |
| | | DR | 1953..1987 |
| | | DR | 2019..2053 |
| | | DR | 2085..2119 |
| | | DR | 2151..2185 |
| | | DR | 2217..2251 |
| | | DR | 2283..2317 |
| | | DR | 2349..2383 |
| | | DR | 2415..2449 |
| | | DR | 2481..2515 |
| | | CDS | complement(2488..3660) /product="orf(18,35204,19359,15)$zz$ORF @ 3332-4505" |
| | | CDS | complement(2493..2714) /product="orf(18,35204,19359,18)$zz$ORF @ 4278-4500" |
| | | POI | 2653..5532 /product="-> IscB(346,448)[44.9] \| cas9(395,449) [25.9] \| pfam13395(402,446)[29.0] \| COG1403(367,465) [27.1] : A(18,35204,19359,2)$zz$5-methylcytosine-specific restriction endonuclease McrA & COG1403" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | 2653..5532<br>/product="–> IscB(346,448)[44.9] | cas9(395,449)[25.9] |<br>pfam13395(402,446)[29.0] | COG1403(367,465)[27.1] :<br>A(18,35204,19359,2)$zz$5-methylcytosine-specific restriction endonuclease McrA & COG1403" |
| | | CDS | complement(2928..3305)<br>/product="orf(18,35204,19359,17)$zz$ORF @ 3687-4065" |
| | | CDS | 3083..3364<br>/product="orf(18,35204,19359,16)$zz$ORF @ 3628-3910" |
| | | CDS | complement(3519..3944)<br>/product="orf(18,35204,19359,14)$zz$ORF @ 3048-3474" |
| | | CDS | 3855..4235<br>/product="orf(18,35204,19359,13)$zz$ORF @ 2757-3138" |
| | | CDS | 4266..4592<br>/product="orf(18,35204,19359,11)$zz$ORF @ 2400-2727" |
| | | CDS | 4370..4585<br>/product="orf(18,35204,19359,12)$zz$ORF @ 2407-2623" |
| | | CDS | complement(4519..4788)<br>/product="orf(18,35204,19359,10)$zz$ORF @ 2204-2474" |
| | | CDS | complement(5050..5334)<br>/product="orf(18,35204,19359,9)$zz$ORF @ 1658-1943" |
| | | CDS | 5459..5662<br>/product="orf(18,35204,19359,7)$zz$ORF @ 1330-1534" |
| | | CDS | complement(5468..5845)<br>/product="orf(18,35204, 19359,5)$zz$ORF @ 1147-1525" |
| | | CDS | complement(5500..5724)<br>/product="A(18,35204,19359,1)$zz$hypothetical protein &<br>Hypo-rule applied" |
| | | CDS | 5653..5961<br>/product="orf(18,35204,19359,4)$zz$ORF @ 1031-1340" |
| | | CDS | complement(5724..6992)<br>/product="orf(18,35204,19359,0)$zz$Partial ORF @ 0-1269" |
| | | CDS | 5780..6991<br>/product="orf(18,35204,19359,2)$zz$Partial ORF @ 1-1213" |
| | | CDS | complement(5873..6991)<br>/product="A(18,35204,19359,0)$zz$hypothetical protein &<br>Hypo-rule applied" |
| | | CDS | complement(5876..6991)<br>/product="orf(18,35204,19359,1)$zz$Partial ORF @ 1-1117" |
| | | CDS | 6610..6990)<br>/product="orf(18,35204,19359,3)$zz$Partial ORF @ 2-383" |
| 128 | 0194044_10012301<br>(Accession<br>0194044_10012301) | CDS | complement(3..740)<br>/product="–> pfam01738(45,246)[37.6] |<br>COG0412(32,246)[64.9] :<br>A(16,30309,12300,0)$zz$carboxymethylenebutenolidase &<br>KO:K01061" |
| | | CDS | complement(1192..1998)<br>/product="A(16,30309,12300,1)$zz$hypothetical protein &<br>Hypo-rule applied" |
| | | CDS | 2175..2375<br>/product="orf(16,30309,12300,2)$zz$ORF @ 2174-2375" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | POI | 2388..3788<br>/product="–> IscB(1,89)[30.9] | IscB(347,446)[44.9] |<br>pfam14239(1,111)[34.7] | pfam13395(403,450)[27.0] :<br>A(16,30309,12300,2)$zz$RRXRR protein/HNH endonuclease & pfam14239,pfam13395" |
| | | CDS | 2388..3788<br>/product="–> IscB(1,89)[30.9] | IscB(347,446)[44.9] |<br>pfam14239(1,111)[34.7] | pfam13395(403,450)[27.0] :<br>A(16,30309,12300,2)$zz$RRXRR protein/HNH endonuclease & pfam14239,pfam13395" |
| | | CDS | complement(2408..2614)<br>/product="orf(16,30309,12300,4)$zz$ORF @ 2407-2614" |
| | | CDS | 2956..3141<br>/product="orf(16,30309,12300,5)$zz$ORF @ 2955-3141" |
| 129 | 0208980__10011278<br>(Accession<br>0208980__10011278) | CDS | 209..442<br>/product="orf(19,37334,11277,12)$zz$ORF @ 4780-5014" |
| | | CDS | complement(212..406)<br>/product="orf(19,37334,11277,13)$zz$ORF @ 4816-5011" |
| | | CDS | 646..888<br>/product="orf(19,37334,11277,11)$zz$ORF @ 4334-4577" |
| | | CDS | complement(1003..1203)<br>/product="A(19,37334,11277,3)$zz$hypothetical protein" |
| | | CDS | complement(1312..1479)<br>/product="orf(19,37334,11277,8)$zz$ORF @ 3743-3911" |
| | | POI | 1544..4408<br>/product="–> IscB(1,168)[25.8] | IscB(350,445)[34.5] :<br>A(19,37334,11277,2)$zz$hypothetical protein" |
| | | CDS | 1544..4408<br>/product="–> IscB(1,168)[25.8] | IscB(350,445)[34.5] :<br>A(19,37334,11277,2)$zz$hypothetical protein" |
| | | CDS | 2007..2282<br>/product="orf(19,37334,11277,7)$zz$ORF @ 2940-3216" |
| | | CDS | complement(3293..3535)<br>/product="orf(19,37334,11277,6)$zz$ORF @ 1687-1930" |
| | | CDS | complement(3635..3847)<br>/product="orf(19,37334,11277,5)$zz$ORF @ 1375-1588" |
| | | CDS | 3849..4040<br>/product="orf(19,37334,11277,4)$zz$ORF @ 1182-1374" |
| | | CDS | complement(4416..4571)<br>/product="A(19,37334,11277,1)$zz$hypothetical protein" |
| | | CDS | 4583..4786<br>/product="orf(19,37334,11277,2)$zz$ORF @ 436-640" |
| | | CDS | complement(4909..5220)<br>/product="A(19,37334,11277,0)$zz$hypothetical protein" |
| | | CDS | complement(4912..5196)<br>/product="orf(19,37334,11277,0)$zz$Partial ORF @ 26-311" |
| | | CDS | 4973..5164<br>/product="orf(19,37334,11277,1)$zz$ORF @ 58-250" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| 130 | a0206388_1021286 (Accession a0206388_1021286) | CDS | 3..1115 /product="–> pfam14238(76,267)[79.4] \| pfam14238(1,122)[69.6] : A(16,30007,1760,1)$zz$protein of unknown function (DUF4340)/protein of unknown function (DUF4340) & pfam14238,pfam14238" |
| | | CDS | 3..1112 /product="–> pfam14238(76,267)[79.4] \| pfam14238(1,122)[69.6] : orf(16,30007,1760,8)$zz$Partial ORF @ 3303-4413" |
| | | CDS | complement(3..407) /product="orf(16,30007,1760,12)$zz$Partial ORF @ 4008-4413" |
| | | CDS | complement(41..295) /product="orf(16,30007,1760,13)$zz$ORF @ 4120-4375" |
| | | CDS | complement(314..934) /product="orf(16,30007,1760,10)$zz$ORF @ 3481-4102" |
| | | CDS | complement(535..702) /product="orf(16,30007,1760,11)$zz$ORF @ 3713-3881" |
| | | CDS | complement(783..1025) /product="orf(16,30007,1760,9)$zz$ORF @ 3390-3633" |
| | | CDS | complement(1253..1504) /product="orf(16,30007,1760,7)$zz$ORF @ 2911-3163" |
| | | POI | 1373..4291 /product="–> IscB(21,88)[35.5] \| IscB(372,473) [41.8] \| pfam14239(5,108)[38.3] \| pfam01844(428,472) [22.2] : A(16,30007,1760,0)$zz$RRXRR protein/HNH endonuclease & pfam14239,pfam01844" |
| | | CDS | 1373..4291 /product="–> IscB(21,88)[35.5] \| IscB(372,473) [41.8] \| pfam14239(5,108)[38.3] \| pfam01844(428,472) [22.2] : A(16,30007,1760,0)$zz$RRXRR protein/HNH endonuclease & pfam14239,pfam01844" |
| | | CDS | complement(2044..2289) /product="orf(16,30007,1760,6)$zz$ORF @ 2126-2372" |
| | | CDS | complement(2126..3172) /product="orf(16,30007,1760,4)$zz$ORF @ 1243-2290" |
| | | CDS | 2829..3074 /product="orf(16,30007,1760,5)$zz$ORF @ 1341-1587" |
| | | CDS | complement(3052..3237) /product="orf(16,30007,1760,3)$zz$ORF @ 1178-1364" |
| | | CDS | complement(3653..3850) /product="orf(16,30007,1760,2)$zz$ORF @ 565-763" |
| | | CDS | complement(4138..4413) /product="orf(16,30007,1760,0)$zz$Partial ORF @ 2-278" |
| 131 | 0315282_10004453 (Accession 0315282_10004453) | CDS | complement(352..540) /product="orf(7,281633,4452,33)$zz$ORF @ 9495-9684" |
| | | CDS | 439..1209 /product="orf(7,281633,4452,34)$zz$ORF @ 9582-10353" |
| | | CDS | complement(652..981) /product="orf(7,281633,4452,35)$zz$ORF @ 9795-10125" |
| | | CDS | complement(1358..3073) /product="–> pfam00501(23,459)[270.7] \| pfam13193(467,548)[43.8] \| COG0318(8,567) [319.0] : A(7,281633,4452,7)$zz$fatty-acyl-CoA synthase & KO:K00666" |
| | | CDS | 1523..3163 /product="orf(7,281633,4452,37)$zz$ORF @ 10666-12307" |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | CDS | 2067..2306 /product="orf(7,281633,4452,38)$zz$ORF @ 11210-11450" |
| | CDS | complement(2268..2921) /product="orf(7,281633,4452,39)$zz$ORF @ 11411-12065" |
| | CDS | 3057..3227 /product="orf(7,281633,4452,40)$zz$ORF @ 12200-12371" |
| | CDS | complement(3190..3453) /product="orf(7,281633,4452,41)$zz$ORF @ 12333-12597" |
| | DR | 3285..3306 |
| | DR | 3339..3360 |
| | CDS | complement(3621..4985) /product="orf(7,281633,4452,42)$zz$ORF @ 12764-14129" |
| | CDS | complement(3646..4002) /product="orf(7,281633,4452,43)$zz$ORF @ 12789-13146" |
| | CDS | 3684..7094 /product="-> pfam01039(644,1132)[239.2] \| pfam02786(112,327)[183.5] \| pfam00289(1,107) [128.9] \| pfam02785(343,454)[99.1] \| pfam00364(531,598) [54.6] \| COG1038(1,468)[525.7] \| COG4799(610,1135)[457.2] \| COG0511(458,600)[79.5] : A(7,281633,4452,8)$zz$pyruvate carboxylase/acetyl-CoA carboxylase carboxyltransferase component/biotin carboxyl carrier protein & COG1038, COG4799,COG0511" |
| | CDS | 3961..4182 /product="orf(7,281633,4452,45)$zz$ORF @ 13104-13326" |
| | CDS | complement(4382..4735) /product="orf(7,281633,4452,46)$zz$ORF @ 13525-13879" |
| | CDS | complement(4992..6674) /product="orf(7,281633,4452,47)$zz$ORF @ 14135-15818" |
| | CDS | complement(5471..5704) /product="orf(7,281633,4452,48)$zz$ORF @ 14614-14848" |
| | CDS | 5572..5742 /product="orf(7,281633,4452,49)$zz$ORF @ 14715-14886" |
| | CDS | 5663..6334 /product="orf(7,281633,4452,50)$zz$ORF @ 14806-15478" |
| | CDS | complement(6014..6244) /product="orf(7,281633,4452,51)$zz$ORF @ 15157-15388" |
| | CDS | complement(6446..6727) /product="orf(7,281633,4452,52)$zz$ORF @ 15589-15871" |
| | CDS | complement(6732..6971) /product="orf(7,281633,4452,53)$zz$ORF @ 15875-16115" |
| | CDS | complement(6860..7078) /product="orf(7,281633,4452,54)$zz$ORF @ 16003-16222" |
| | CDS | complement(7231..7845) /product="orf(7,281633,4452,55)$zz$ORF @ 16374-16989" |
| | CDS | 7306..8553 /product="-> pfam02515(9,391)[246.8] \| COG1804(1,415)[251.2] : A(7,281633,4452,9)$zz$benzylsuccinate CoAtransferase BbsE subunit/naphthy1-2-methylsuccinate CoA transferase subunit & KO:K07543,KO:K15569" |
| | CDS | complement(7497..7751) /product="orf(7,281633,4452,57)$zz$ORF @ 16640-16895" |
| | CDS | complement(7882..8568) /product="orf(7,281633,4452,58)$zz$ORF @ 17025-17712" |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | CDS | complement(7887..8063)<br>/product="orf(7,281633,4452,59)$zz$ORF @ 17030-17207" |
| | CDS | 8118..8345<br>/product="orf(7,281633,4452,60)$zz$ORF @ 17261-17489" |
| | CDS | 8412..9797<br>/product="–> pfam02515(6,378)[365.3] \| COG1804(1,402)[323.8] : orf(7,281633,4452,61)$zz$ORF @ 17555-18941" |
| | CDS | complement(8487..9941)<br>/product="orf(7,281633,4452,62)$zz$ORF @ 17630-19085" |
| | CDS | 8636..9478<br>/product="orf(7,281633,4452,63)$zz$ORF @ 17779-18622" |
| | CDS | complement(8702..8962)<br>/product="orf(7,281633,4452,64)$zz$ORF @ 17845-18106" |
| | POI | 10001..12910<br>/product="–> IscB(1,160)[32.7] \| IscB(382,449)[34.1] \| pfam14239(1,99)[32.9] \| pfam13395(407,455)[32.2] : A(7,281633,4452,11)$zz$RRXRR protein/HNH endonuclease & pfam14239,pfam13395" |
| | CDS | 10001..12910<br>/product="–> IscB(1,160)[32.7] \| IscB(382,449)[34.1] \| pfam14239(1,99)[32.9] \| pfam13395(407,455)[32.2] : A(7,281633,4452,11)$zz$RRXRR protein/HNH endonuclease & pfam14239,pfam13395" |
| | CDS | complement(10193..12901)<br>/product="orf(7,281633,4452,66)$zz$ORF @ 19336-22045" |
| | CDS | 10209..10457<br>/product="orf(7,281633,4452,67)$zz$ORF @ 19352-19601" |
| | CDS | complement(10330..10500)<br>/product="orf(7,281633,4452,68)$zz$ORF @ 19473-19644" |
| | CDS | complement(11938..12351)<br>/product="orf(7,281633,4452,69)$zz$ORF @ 21081-21495" |
| | CDS | complement(12613..12780)<br>/product="orf(7,281633,4452,70)$zz$ORF @ 21756-21924" |
| | CDS | 12661..12963<br>/product="orf(7,281633,4452,71)$zz$ORF @ 21804-22107" |
| | CDS | 13150..13377<br>/product="orf(7,281633,4452,72)$zz$ORF @ 22293-22521" |
| | DR | 13193..13229 |
| | DR | 13265..13301 |
| | DR | 13337..13373 |
| | DR | 13407..13443 |
| | DR | 13478..13514 |
| | CDS | complement(13517..13807)<br>/product="orf(7,281633,4452,73)$zz$ORF @ 22660-22951" |
| | CDS | 13560..13736<br>/product="orf(7,281633,4452,74)$zz$ORF @ 22703-22880" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | complement(13642..14733)<br>/product="–> pfam04015(30,227)[149.1] \| pfam00037(303,326)[21.4] \| COG2006(3,287)[196.9] \| COG1145(258,362)[36.4] : A(7,281633,4452,12)$zz$uncharacterized protein (DUF362 family)/ferredoxin & COG2006,COG1145" |
| | | CDS | 13648..14709<br>/product="orf(7,281633,4452,76)$zz$ORF @ 22791-23853" |
| | | CDS | 14021..14197<br>/product="orf(7,281633,4452,77)$zz$ORF @ 23164-23341" |
| | | CDS | 14297..14755<br>/product="orf(7,281633,4452,78)$zz$ORF @ 23440-23899" |
| | | CDS | 15101..15298<br>/product="A(7,281633,4452,13)$zz$hypothetical protein |
| | | CDS | complement(15107..15298)<br>/product="orf(7,281633,4452,81)$zz$Partial ORF @ 24250-24442" |
| 132 | 0172371_10033925<br>(Accession<br>0172371_10033925) | CDS | 1..330<br>/product="A(16,31096,33924,0)$zz$Forkhead associated (FHA)domain, binds pSer, pThr, pTyr & COG1716" |
| | | CDS | 3..227<br>/product="orf(16,31096,33924,0)$zz$Partial ORF @ 2-227" |
| | | CDS | complement(3..182)<br>/product="orf(16,31096,33924,1)$zz$Partial ORF @ 2-182" |
| | | CDS | 28..327<br>/product="orf(16,31096,33924,2)$zz$Partial ORF @ 27-327" |
| | | CDS | 371..742<br>/product="A(16,31096,33924,1)$zz$Tautomerase enzyme/Tautomerase enzyme & pfam14552,pfam01361" |
| | | POI | 1236..3893<br>/product="–> IscB(1,62)[34.0] \| IscB(344,452) [45.0] : A(16,31096,33924,2)$zz$RRXRR protein/HNH endonuclease & pfam14239,pfam01844" |
| | | CDS | 1236..3893<br>/product="–> IscB(1,62)[34.0] \| IscB(344,452) [45.0] : A(16,31096,33924,2)$zz$RRXRR protein/HNH endonuclease & pfam14239,pfam01844" |
| | | CDS | complement(1256..1528)<br>/product="orf(16,31096,33924,5)$zz$ORF @ 1255-1528" |
| | | CDS | complement(1556..1798)<br>/product="orf(16,31096,33924,6)$zz$ORF @ 1555-1798" |
| | | CDS | complement(1629..1880)<br>/product="orf(16,31096,33924,7)$zz$ORF @ 1628-1880" |
| | | CDS | complement(1856..2056)<br>/product="orf(16,31096,33924,8)$zz$ORF @ 1855-2056" |
| | | CDS | complement(2093..2266)<br>/product="orf(16,31096,33924,9)$zz$ORF @ 2092-2266" |
| | | CDS | complement(2472..3047)<br>/product="orf(16,31096,33924,10)$zz$ORF @ 2471-3047" |
| | | CDS | 2971..3198<br>/product="orf(16,31096,33924,11)$zz$ORF @ 2970-3198" |
| | | CDS | complement(3239..3568)<br>/product="orf(16,31096,33924,12)$zz$ORF @ 3238-3568" |

TABLE 15-continued

Geneious Features and Annotations for SEQ ID NOs: 93-133 (See also Appendix B of U.S. Provisional Application No. 62/962,672)

| SEQ ID NO: | Name | Features | Location/Qualifiers |
|---|---|---|---|
| | | CDS | 3440..3793<br>/product="orf(16,31096,33924,13)$zz$ORF @ 3439-3793" |
| | | CDS | complement(3444..3665)<br>/product="orf(16,31096,33924,14)$zz$ORF @ 3443-3665" |
| | | CDS | 3838..4011<br>/product="orf(16,31096,33924,15)$zz$ORF @ 3837-4011" |
| | | DR | 4305..4341 |
| | | DR | 4377..4413 |
| | | DR | 4450..4486 |
| | | CDS | 4503..4685<br>/product="orf(16,31096,33924,16)$zz$ORF @ 4502-4685" |
| | | DR | 4522..4558 |
| | | DR | 4594..4630 |
| | | DR | 4667..4703 |
| | | CDS | 4725..4901<br>/product="orf(16,31096,33924,17)$zz$ORF @ 4724-4901" |
| | | DR | 4738..4774 |
| | | CDS | complement(4740..4970)<br>/product="orf(16,31096,33924,18)$zz$ORF @ 4739-4970" |
| | | CDS | complement(4807..5067)<br>/product="A(16,31096,33924,3)$zz$hypothetical protein & Hypo-rule applied" |
| 133 | 0315295_10011535<br>(Accession 0315295_10011535) | CDS | 3..104<br>/product="A(7,281646,11534,8)$zz$hypothetical protein" |
| | | CDS | complement(284..418)<br>/product="A(7,281646,11534,7)$zz$hypothetical protein" |
| | | CDS | 743..1297<br>/product="-> KOON_icity0084(7,175)[26.1] \| pfam01936(5,174)[93.7] \| COG1432(1,179)[62.3] : A(7,281646,11534,6)$zz$uncharacterized LabA/DUF88 family |
| | | POI | 1487..4351<br>/product="-> IscB(3,76)[30.0] \| IscB(354,449)[32.3] \| pfam13395(410,458)[29.0] \| pfam14239(1,93)[27.1] : A(7,281646,11534,5)$zz$HNH endonuclease/RRXRR protein & pfam13395,pfam14239" |
| | | CDS | 1487..4351<br>/product="-> IscB(3,76)[30.0] \| IscB(354,449)[32.3] \| pfam13395(410,458)[29.0] \| pfam14239(1,93)[27.1] : A(7,281646,11534,5)$zz$HNH endonuclease/RRXRR protein & pfam13395,pfam14239" |
| | | CDS | 2058..2264<br>/product="orf(7,281646,11534,12)$zz$ORF @ 5407-5614" |
| | | CDS | complement(2498..2761)<br>/product="orf(7,281646,11534,11)$zz$ORF @ 4910-5174" |
| | | CDS | complement(3164..3424)<br>/product="orf(7,281646,11534,9)$zz$ORF @ 4247-4508" |
| | | CDS | complement(3181..3402)<br>/product="orf(7,281646,11534,10)$zz$ORF @ 4269-4491" |
| | | CDS | complement(4532..4759)<br>/product="orf(7,281646,11534,7)$zz$ORF @ 2912-3140" |
| | | DR | 4559..4586 |
| | | DR | 4629..4656 |

TABLE 15-continued

Geneious Features and Annotations for SEQ ID NOs: 93-133 (See also Appendix B of U.S. Provisional Application No. 62/962,672)

| SEQ ID NO: Name | Features | Location/Qualifiers |
|---|---|---|
| | DR | 4697..4724 |
| | DR | 4768..4795 |
| | CDS | 4812..5003 /product="orf(7,281646,11534,6)$zz$ORF @ 2668-2860" |
| | DR | 4839..4866 |
| | DR | 4910..4937 |
| | CDS | complement(5134..5511) /product="A(7,281646,11534,4)$zz$hypothetical protein" |
| | CDS | 5162..5329 /product="orf(7,281646,11534,5)$zz$ORF @ 2342-2510" |
| | CDS | 5596..5898 /product="A(7,281646,11534,3)$zz$hypothetical protein" |
| | CDS | 5905..5991 /product="A(7,281646,11534,2)$zz$hypothetical protein" |
| | CDS | 6002..6691 /product="A(7,281646,11534,1)$zz$hypothetical protein" |
| | CDS | 6787..7110 /product="orf(7,281646,11534,1)$zz$ORF @ 561-885" |
| | CDS | 7229..7426 /product="A(7,281646,11534,0)$zz$hypothetical protein" |

Various modifications and variations of the described methods, pharmaceutical compositions, and kits of the invention will be apparent to those skilled in the art without departing from the scope and spirit of the invention. Although the invention has been described in connection with specific embodiments, it will be understood that it is capable of further modifications and that the invention as claimed should not be unduly limited to such specific embodiments. Indeed, various modifications of the described modes for carrying out the invention that are obvious to those skilled in the art are intended to be within the scope of the invention. This application is intended to cover any variations, uses, or adaptations of the invention following, in general, the principles of the invention and including such departures from the present disclosure come within known customary practice within the art to which the invention pertains and may be applied to the essential features herein before set forth.

SEQUENCE LISTING (140 sequences)

SEQ ID NO: 1 - protein, 15 aa, synthetic construct
  REGION 1..15: note = Synthetic glycine serine linker
GGGGSGGGGSGGGGS

SEQ ID NO: 2 - protein, 5 aa, synthetic construct
  REGION 1..5: note = Synthetic sortase recognition sequence
  SITE 3: note = misc_feature - Xaa can be any naturally occurring amino acid
LPXTG

SEQ ID NO: 3 - protein, 4 aa, synthetic construct
  REGION 1..4: note = Synthetic
  SITE 4: note = MISC_FEATURE - Biotin Handle
GGGK

SEQ ID NO: 4 - protein, 7 aa, Simian virus 40
PKKKRKV

SEQ ID NO: 5 - protein, 10 aa, Simian virus 40
PKKKRKVEAS

SEQ ID NO: 6 - protein, 16 aa, synthetic construct
  REGION 1..16: note = Synthetic nucleoplasmin bipartite NLS
KRPAATKKAGQAKKKK

SEQ ID NO: 7 - protein, 9 aa, Homo sapiens
PAAKRVKLD

SEQ ID NO: 8 - protein, 11 aa, Homo sapiens
RQRRNELKRSP

SEQ ID NO: 9 - protein, 38 aa, Homo sapiens
NQSSNFGPMKGGNFGGRSSGPYGGGGQYFAKPRNQGGY

SEQ ID NO: 10 - protein, 42 aa, Homo sapiens
RMRIZFKNKGKDTAELRRRRVEVSVELRKAKKDEQILKRRNV

SEQ ID NO: 11 - protein, 8 aa, Homo sapiens
VSRKRPRP

SEQ ID NO: 12 - protein, 8 aa, Homo sapiens
PPKKARED

SEQ ID NO: 13 - protein, 8 aa, Homo sapiens
PQPKKKPL

SEQ ID NO: 14 - protein, 12 aa, Mus sp.
SALIKKKKKMAP

SEQ ID NO: 15 - protein, 5 aa, Influenza virus
DRLRR

SEQ ID NO: 16 - protein, 7 aa, Influenza virus
PKQKKRK

SEQ ID NO: 17 - protein, 10 aa, Hepatitis delta virus
RKLKKKIKKL

SEQ ID NO: 18 - protein, 10 aa, Mus sp.
REKKKFLKRR

SEQ ID NO: 19 - protein, 20 aa, Homo sapiens
KRKGDEVDGVDEVAKKKSKK

SEQ ID NO: 20 - protein, 17 aa, Homo sapiens
RKCLQAGMNLEARKTKK

SEQ ID NO: 21 - protein, 12 aa, synthetic construct
  REGION 1..12: note = Synthetic
FWYHKMILVAGC

SEQ ID NO: 22 - protein, 4 aa, synthetic construct
  REGION 1..4: note = Synthetic
FWYH

SEQ ID NO: 23 - protein, 12 aa, synthetic construct
  REGION 1..12: note = Synthetic
WYHKREDCSTNQ

SEQ ID NO: 24 - protein, 5 aa, synthetic construct
  REGION 1..5: note = Synthetic
HKRED

SEQ ID NO: 25 - protein, 9 aa, synthetic construct
  REGION 1..9: note = Synthetic
VCAGSPTND

SEQ ID NO: 26 - protein, 7 aa, synthetic construct
  REGION 1..7: note = Synthetic
AEAAAKA

SEQ ID NO: 27 - protein, 15 aa, synthetic construct
  REGION 1..15: note = Synthetic glycine linker
GGGGGGGGGGGGGGG

SEQ ID NO: 28 - protein, 6 aa, synthetic construct
  REGION 1..6: note = Synthetic
KCCYSL

SEQ ID NO: 29 - protein, 7 aa, synthetic construct
  REGION 1..7: note = Synthetic
YEVGHRC

SEQ ID NO: 30 - protein, 8 aa, synthetic construct
  REGION 1..8: note = Synthetic
GPLGIAGQ

SEQ ID NO: 31 - DNA, 1993 bp, synthetic construct
  misc_feature 1..1993: note = Synthetic
  source 1..1993: mol_type = other DNA
atgccgcccggattttccttgtcgacgcccgggcgcggccgtatgctcccaactcatggtggccaacgccctggggatagacttgggcggcaaggcagtggggcttgctgtgctggagcgaccgggcaaccgcgtcctgtggtgcggaacggtccacctctccgacaagatcaaggatctctacgaccagcggcggacgctgcgccgggcgcgccggggccgcgggcgctaccgcaagccgaaggtcccccagcgaggcggaggatcggcgggccagacccagtggagcggcttccgctaccggcgcgccaagggcctcaaccagtccctccgaaccaagtgcaagtacgtcgatcccgacacgggcgaggtctgcggaaggaacacggcgaagcgctccaatgtccggcatcttttcctggaggacatcctcggcttcgcgccgttctcggacgtcccggccgactacaagcaggccatccgcgacgtgctggcgtcgagggaaggcatcgcaacgcggaagcagcgcctcgcggccgtcctgagccggatcgacgtggaccggtacctcaagaagcagatcacggagatctgcttcgacgagcgcgggggacgcgcggagttctgccgggaccacatccccgcccgccacacgcagaccgccatccccacgcaggccgtctggctccccccgtccattcggatcaagcaggacttcctcctcaagcatgtccgccaacttgccgccagcgtccgcatcgaccgcatcgtcatcgagcgcgccaacttcgacctccagaagatcgcgaagggagtgatcgacgatcccgcggagtaccagcagggcgcccggtacggcttccgcaacacgcggatggccctcatgcaggagtacggcgcccgttgctgctactgcggcaagagcgtcgtcggcgagaagtggcacgtggaccacatcgacccgcggcgtacgggcgagacgaaccgctggaacaacctcgccatcgcctgcgagaagtgcaaccacaagaaaggcgggcggacgcccctcgatgcgggcatggccttcgccgtggtcggcgagaccgtcgccggccggcgcatccggcgccggctggagcccaagccgctcgccggaagccgtatcaacaagtacatgacgcagaccgaccagggcatccggatcctcaagcgctccctcgccgagatcgtccccggcgcgcccatcgaggagacctacggctacgtgacgagcgcctggcgggacctgtggggcctggagaagggcagggagaagcaggagcaccacaacgacgcgatcgtcatcgcctccctgcgcgaagttgccgccgtccccatcgtcgaggtctcaccgcaggcgatccggcagaccgtcggcggcaagcgcctcttcgacctcaaccccgtccagcgcgcgcgcgacgcgaagtactaccagcgcggcccggtggtcgcggaggtcggcgggatcgcgccggcccaactgcctgcggtcgtggacgagcgcaaacgcaagctgctcgcccgcgagttcgctcgctacggcgtcacgggcaggaagccgctgccgccgccggcgctggatcgcctccccttcaagagcgtccgcctccgcaagcgcgactgcacggatgccaacgtgcgtcggatggcgacgggccaccgcttcaagctcagcaaccccggcggcacgcgcgtcaaccaggccgtcgtcgtgtatctcacgtccgctggcaagcgggcgtcctacgccgtcaagaacacccgggccttcggcccgacggcgccgcccgacgacctcgaccgcgagctgtggcgcttccgcccgggagatgcggtcgccgatcgggacggcggcgcgatcgggcgcgtcgtcaagctcggcagcgacgggacgctgacactcgattccggcaagacacgaaaggcacacacgtgcagcaagggaggtggtcgaatgaccacgagctag

SEQ ID NO: 32 - DNA, 181 bp, synthetic construct
  misc_feature 1..181: note = Synthetic
  source 1..181: mol_type = other DNA
gaggtcagaagcagccagagcgaaggcccccgatggggcctgccagggaacccaacgaaaggcgggacctggccagcagctacgtttgcaggaaaggtcaagacctatgccgggatgtagtgatctcgtctacccagtcccggcctcttggagtctcgacccggaagatcaacgccccagc

SEQ ID NO: 33 - DNA, 30 bp, synthetic construct
  misc_feature 1..30: note = Synthetic
  source 1..30: mol_type = other DNA
attctggcctctcgcgggcgtgggacgatg

SEQ ID NO: 34 - DNA, 28 bp, synthetic construct
  misc_feature 1..28: note = Synthetic
  source 1..28: mol_type = other DNA
cgcgaggcctcgcctgcgtgggacgatc

SEQ ID NO: 35 - DNA, 28 bp, synthetic construct
  misc_feature 1..28: note = Synthetic
  source 1..28: mol_type = other DNA
attctggcctcgcgggcgtgggacgatg

SEQ ID NO: 36 - DNA, 28 bp, synthetic construct
  misc_feature 1..28: note = Synthetic
  source 1..28: mol_type = other DNA
attctgggctcgcgggcgtgggacgatg

SEQ ID NO: 37 - DNA, 1977 bp, synthetic construct
  misc_feature 1..1977: note = Synthetic
  source 1..1977: mol_type = other DNA
atgcaaggacaaaaacttggtatagatttaggcggtaagcatgtcggtcttgctgttgtaagaacaccgataaacgaggtggcacattactgcactattgaactcagagaagacattaaggataagatggatgagaggaggtctcttcggagggcgaggagaaacaggctctggcatagggaagcgaggtttgacaataggcaattaagggtgaaatgcaaatatattgataaagatacaggcgaaatctgcggagctaatactccaaagaaatccaatgtaaaacatcttctacttgagaatatactcgtcaatcttaaaatagctgatgaatctaaagaggaaatcagaagaagagggctggacagagacacaaacaaaagtgaattacagacaatccttgagaaattttcaataaataccttcctgaaaaaacagattaaagacatcattcttgaaaagggggaagggagggctgtcttttgcagagagcatatcccctttcattatgaacaggttgcaacagaggctgagagtttctggctgtcaaattcaataagggctaaacaggaccagatactctcccgccttaaaagaatagcaaaggattttaagatagatgaggtggttattgaaagggcgaactttgatttgcaaaagctccagagacctgatgagatagaagcacctgaagattacatgaagggtcctaacttcgggcacagaaacaggtttgaggcattgaagcaggaatatggcaaccgatgctgtttctgcggaaagaagggtggagatgaagtaaagctgaagatagggcatctctatccgaaggctaaagatgagataaacaggtgggaaaaccttataactatatgtgaaaaatgtaatgcgaagcagggtaaaaggacaccagaggaggcagggatggaatttgtaattgtaaaggagaaggtttttaatcctgcagcaggaagggtaatacccataaaaagagaactcaagccgaagcccataaatgaatcaaaggttaataaatatatgacccatactgatattggcataaggaggctcaaaagagaaatccagaatatttttggaagcatacctataagagaaacatacggctatatcacatcgtattttagaaataaatgggagcttgaaaaagaacattataatgatgctgtagtcatagcctctgacaaagaagatttgaatataaaacctgtatttaaagatgcagtccctcagacaattaaatcatctatcaagggcgggaaactctttgatacaaatcccctccagtttagtgatggaaagttttaccagaacataacccttataggcagaaaggcagggatgcgttcatcaaaacataaaaggggtcagaggaatatcaggaactatggctcaatttatatggatgagattgaacttataacctcagaatggaagaaaaaggttctctgcgaattaagagataaacttggttatgtaaaaggagataagaataagtcttttaagcctgaggaactgatgaatgcaaatctgcctttcaggactgtaactattgacaaaaggggtgtaggagaatcttcaacccgcttaatcaataacaatgtattccgtgcctcagctgaagtaaatacgcatataatggtctattcaaataatgacggtagaatgaaggcatttgcagtaaaaaatcctaagatatttaaagatgccggactccctcatgattttcaaaaaaagatattcattgtaaaaaagggggatattgttacatggaaaaaaagtgaagatggaattgccgtaacaggcagggtgaccaaatgtttgacaaaaaatggggtaattgatataaaggacatgaataataaaatacactcagggaaaaaccctgtgtatattgaaaagatagtatctcctgaaaggggtgctatttttgagagaaaatctctttctgctctttga

SEQ ID NO: 38 - DNA, 28 bp, synthetic construct
  misc_feature 1..28: note = Synthetic
  source 1..28: mol_type = other DNA
tttcaatctaacacagtggcattaaaac

SEQ ID NO: 39 - DNA, 1836 bp, synthetic construct
  misc_feature 1..1836: note = Synthetic
  source 1..1836: mol_type = other DNA
ctcaaactcatcgaactcgaactccgggacgacatcaaggacagaatggaagagcggagggcgctgcgcaggcatcgcaggcagcggaaaaggtaccgcaggcccatcgagcctgaccgccagggcggtgtcaggtccgcccccccctaccgcagagcctgcggtcagaaccgcgcatcgaccatgaaatgcatgttcgtcaatcccgtcaccggtgaaaaatgctccctcaatgctccacttaaaaagaacatccgccgcgaactcatggcaatcaccctgaagaattcggacattccaccgggtctgaaagacaatctcgtctcatgtttcgaccggaagcggaacccgcccctcagcacttctgatctcatggcccagctccggaaatggaacgccccctcgcagaccgtccgcatggttgaacaactcctgcacggcaacctgcacggccgctccgactactgccgcgcgcacctgcatgcctgcgccggagactggaccgccgagcggcactccatgcccctttcgaattccgtcctcgcaaaacactcctctctcgtcagccttcttaaaaaactgtcgaagtattacaacatcgacagagtccgcatcgaggattccaacttcgatcctgaattaatacgttccggccgcctgctggattccggggcaggagcggaccggccggatttcctcaagaaaaatactttcaaggccctgcagcacgagtatttaaaccgctgctgctactgcggcagggacggaagcagtacccgtctcgagatcgagcacgtgatcccgaaatccctcggcggttccgacacctgggagaatctcgttctggcctgcggcgattgcaactcccggaagggctggcggacccccgaaaccgccggtatggattttcacgtcctggaaggtgtgattgtcgccggcgtgccgcgccgggtttctctggaaccggtccctttcgagcgctcccggacccgcggattcatggataagaccgatcccggcaaacgaaccgtcaggaaacacctccggcaggtttttccgctggcggaattcgagttcgacttcggctacaggacttcatatctgagaaacaagtggaactgggaaaaatcgcgctgctgcgacgctgctgtgatcgcggccatggccggcggcgagataccaggcgctccccccaccattccactggaaaaatcagttttgaaatttaattccggcggcggaaaactgttcgatacatttcccgtttcaaaaaccggcgccggctacgtgcagggccgaaccctcataagccgcgacggcaggtttgccagattcacgtggggggaaattaaaagggtggcttcaccagggaaaaagcgcatccttgaaaaacttaaggagaaagccggtgtgggcgccgtatccgacgcagaccttatcccggacgaccttttagagaccctgcccttccgccgtgttaccctcaagagaaaggatgtcggcgcttccgccgtccgcgggatcaacggcaattatttcaaggcggagcaccccaactggggaacagccgtttatttggataaaaacgggaagaaaaatttcttcatgattaagaacgcaagggtatttggaaaaacacagcctcccgaagattttgccaggctccttttcatcatcaggaagggagaccgtgtgaagttcacttacaagaacaggcagcggattgaaaaagtttatgcgaacttctcgaacgggagccttaaactgcttacggccgatggcgagacaatcatgaaaagcgctaaatcctgcgtccccgccggtggacgggacata

SEQ ID NO: 40 - DNA, 1938 bp, synthetic construct
  misc_feature 1..1938: note = Synthetic
  source 1..1938: mol_type = other DNA
atggcaaacgtccttgggatagacctgggcggcaaggcggtggggctggccatcgtccagcagccggagaatcaggttctctggtgcggcaccgttcacctctcggatcggatcaaggacctctacgaccaacgccgcgttctgcgccgcgcccggcgctcccgcgtccgctaccgcaagccgaaggtccagcagcgcggcggcggctccggcggccggggaaccgaaggcgccacctacttctacaagcgtgcgaagggcctcaatcagtcgctccgcagaaagtgcaagtacgtggaccccaacaccggcgaagtctgcggccgcaacacgcccaagcgaggcaacgtccgccacctgctgatcgaggacatcctgagcaactactcgcccttcgccacagtcgatgcaacgctgaagcaagcgattcgcgacatcctcgccagtcgcgaaggaatcactcgccgccaggagcggctcaagaatgttctcgacctcatcgacatcaacgccgacctgaagaagcagatcaccgatatcttgtttggcacaggcgagcgccgctgtgagttctgccgcgaccatatcctctcccaccacgagcagacgcagacgccggccgatccccgttggctgccgccttcgatccggctcaagcaggagtttctcctcaagcaggttcgccgcctcgcgcaccgttaccgcattgaccgcgtcgtcatcgagcgggcaaggttcgaccttcagaagatcgcccgcggcgtcatcgacgacccggccgagtaccagcagggccaccgatacggcttccggaacgtccgggcggccctctttcaggagttcagcggccactgctgctattgcgggcggagcgtcattgacaagaagtggcacgttgaccatgtggacccgcgccgcaagacgggggcggggcggtgggacaacctggccgtcgcctgcgagtcctgcaaccacacgaagggcggccggtcgccgcaggaagcggggatggcgttcgcgaccatcccggcggtcgtcgcggggcgccgcatccgccggtcgctcgcgccaaaaccgattgaaggcgcccgcatccacaagtatatgacgcagacggaccagggcatccgaatcctcaagcgcgagctgcgggaaatccttggggccgtcgagatcgacgagacgttcggatacgtcacgagcgcctggcgagacctgtgggagttacccaaggggcgcgagacgaacgaacaccacaacgacgccatcgtgatcgcggccaacctcacgccggatgcccgccccaagctcgacggcgagccggaagccgtccggcagttgatcggcggcaagcgactgtacgatcagaaccccgtttcccggcggggcgacgggaagtactaccagcgtcagccggtgctggccgagcaaggcggcatcacgcgccggcagcttcgccaagtggtggacgagcgcaggcgacgtatcctcgccgccgcgttcgagtaccacggcgtcaagggcaacaagacgctgccgcccgccgcgctccagcagttgccattcaagagcgtgcggctgcgcaaggccgactgcaccgatgagaacacccgcgctctcccggcccggaaccgccggcatcgctacaagatctccaacacaggcggaacgcgcgtgaacgaggcagtggccgtgtatcaaacgaccggcggtcgccgggcctgctacgccgtgaagaaccggcgcgtcttcggacggacgccgcccccggaggacctcgcgaaggaactgtggcgcgtgcggcccggcgatacgctccacgattcgtcgggcgacgtgctgggcgccgtcgtgaagctgggaagcaacgggacgctgacgctggatagcgggagaacccgaatggctcaccgatgccacagggcgatcagcccctga

SEQ ID NO: 41 - DNA, 181 bp, synthetic construct
  misc_feature 1..181: note = Synthetic
  source 1..181: mol_type = other DNA
cgagttcggaagcagcctcagcgatcccgagagatcgggagccagggaacccaacgaaaggcgggacctggccagaagctacgtttgcaggacagctgaagacctatgccgggatgtagtgatctcgtctacccagtcccggccccttggagtctcggcccacaagatcaacgccccagcg

SEQ ID NO: 42 - DNA, 28 bp, synthetic construct
  misc_feature 1..28: note = Synthetic
  source 1..28: mol_type = other DNA
aacgctgacccgcgtgcgtgggagtgat

SEQ ID NO: 43 - DNA, 28 bp, synthetic construct
  misc_feature 1..28: note = Synthetic
  source 1..28: mol_type = other DNA
attccggactcgcgtgcgtgggagtgat

SEQ ID NO: 44 - DNA, 2019 bp, synthetic construct
  misc_feature 1..2019: note = Synthetic
  source 1..2019: mol_type = other DNA
gtgaatacggaaacgcgagagcaggtgttggggattgacttcggcccgaagcacgtgggaattgctctcgtggcgaggggggcctcgtcggaggaagtcctcttcgtcgcggaggtgcggctgagggaccgcaagtcgctgctggccgaccggcgggcgctgcggcgcgggcggcgaggcaggaagcgctaccgccagcccaagattccacagcggggcggtggcgcgacgtcgcaaagcggcgaggagagcgagagggggcgcgccgcagccccggagtatcgtcgcgccacagggctcaacacagggcgacgacgctgcaagtttgtcgacccccagacgggtgaaatatgcgggtggaatacgccccgcaaggccaacgtccgcgacctcctgctgtggaacatctgccgccaccttccggtgtctgtctccgagcaggcggggttcctcgcttacgtcaaccagacgaacctccaccgcgcggagatactgggtgctctgccggcggaagagcaggccccgctggaggccgtgttctcgcaacagcggcggccgaaagacgagcggctgaaggaccggctacgaaggctcggcgttgaccggcacctgcgctcgcaggtcacggacatcgttggcatcacctctcgccggccgctcagcgggcggctgtctttctgccgcgagcatttcctgcgccaccacgagcagagccgcgttccccggcccagcgtgtggctcccgaacactgttgagatgaagcaagcggatgtgctaaaggtctgccggcaggaggtcgcgccgcgctggcgtgttgactgcatagtgctagagcgggccaacttcgacttgcagcttctccggcagcagaccgccatcgaatggtcggtggaggactggcagcgcggcccgcggtggggctaccgcaacaccttcgaggcgaagaagcaggagcaggggaaccgctgcgcctactgcggcagcaagccgacggcgaagaaccggctgaggctggaactggagcacgtcattccaggtgggggcgacacgtgggagaacctggtgctaagctgccggaagtgcaacgagggcaagggtaatcgcagccctgcgcaggccggcatgcgcttctggacggacaccgagacgggagagacgctctccccggcgccgctcggcgccgcgcacgtttcccgctacatgacccagacggaccaggggtggcgtcgccttcaggccgcgctacagcaggtcttcccccaggccgcagtcgagcacacctgggggtacgtgacgagcttctaccgtaaccgctggaacctccccaagaagcacttcgtggacgcggccgtcatcgccagctcgcacgagcttgagcgccccgtgtccgtgcccgaacagccccagcggtttgctccgacatccggcggcaagcagctcttcgacacgaaccccctctcaaagcggccggaggggcgcttcgctcagagcaaggcgattgtgtgcgagcaggggacgctcgccttcaaagatgtcgccaaggtagagaacccgcgcaagcgcgccacgcttcagcgcgtcgcggatgaggccaccgcagcagcaaaggcgcggggcgaaaccccgcccaccgcgttcaccgctgaaatgctgccgaagataccattcaagtctgtgcgccttgccaagcaggacgctagcgacaccaacacacgccgactcggccggcattggttcaaggtcgcaagcgccgtgaatatcgcgaccatcgtctaccagctcgacgggaaggtttgcatgcaactccaacgcaaccccgcggtcttccgtcatgaccctggcttgccgcagggggcgcgcgttgtcgccaccttccgcaagggcgacctggtggagtgtgacgcgggccgcggtcgggtaacgaagaaccacagtaactgcactctcaccgtcgaactgctggacagtggcaaggaggtgacgaggctggcgaagtcgttcaggccgcggcatggctag

SEQ ID NO: 45 - DNA, 187 bp, synthetic construct
  misc_feature 1..187: note = Synthetic
  source 1..187: mol_type = other DNA
gaagggcgaaagcagcccagccaagtctccgcccatggcggagcacgggaaaccggtggggaaacccggccggccaccgtaaggaggcacgtttggggaacaggtaggggtaaccctgagtgcaacctggggtgcaccttcagctccaggctctgcaaggctcggcccagaggattaacgccctaat

SEQ ID NO: 46 - DNA, 28 bp, synthetic construct
  misc_feature 1..28: note = Synthetic
  source 1..28: mol_type = other DNA
tttcgccctcgcattggtggacagcacg

SEQ ID NO: 47 - DNA, 28 bp, synthetic construct
  misc_feature 1..28: note = Synthetic
  source 1..28: mol_type = other DNA
tttcgccctcgcattggtggacagcacc

SEQ ID NO: 48 - DNA, 28 bp, synthetic construct
  misc_feature 1..28: note = Synthetic
  source 1..28: mol_type = other DNA
tttcgccctcgcattggtggacagcact

SEQ ID NO: 49 - DNA, 1920 bp, synthetic construct
  misc_feature 1..1920: note = Synthetic
  source 1..1920: mol_type = other DNA
atggagaacgtcctcgggatagaccttggtgggaaagcggtcgggctggcggtagtcgagcagccctccaaccgcgtccagtggtgcgggaccgtaagactctcggacaagatcaaggacctctacgaccttcggcgaaccctccgccgcgccaggcgaagccgggtgcgttatcgaaagcccaaggtcgccgaaagaggaggcggggccggggggaaaggcgaggagggggcgacctacttctaccggaaagccaaagggctgaatcagtcgctgcggacaaagtgcaagtacgtcgatccccagacgggagaagtctgtggaaagaacacgccccagatggccaatgtccgccacctcctcctggaggacatactcggctttgcgccctttgccccggtgggggaggactgcaagcaggccatccgagacatcctggcctcgcaggacggcgacgcgcgacgccgggaacgcctcgagaacgtcctggggctgatcgatctgtccgaatacctcgaggagcagatcaaggacatcatcttcgggaagggcgacgggcgtgcccagttctgccgctcgcacatcctgggccaccactcgcagaccgagactcccaagcaggccgcgtggttgccgccatcgctgaagctcaagcaggatttcatcctcaaggtcatccgcgagcggggcaagccttgccgcatcgatcgaataataatcgagcgggcgaacttcgacctccagaagatcgcggcgggggtgatcgaagacccgcgcgagtaccagcaagggtatcgctacggatttcgcaatacccgtgcggcgctgatgcaggaatacggggcgaggtgttgttattgcggtaagagcgtggcggggcagaaatggcacatcgaccacgtcgatccgcgcaggacgggcgagatcaaccgctgggacaacctcgccatagcctgtgaaaagtgcaatcacagcaaaggcgggaagacccccaaggacgcgggcatgcgcttcgcggtggtgacggagaaggtcgctgggcgcaagatacgccgctccctggccccgaagcccgtcgagggcacccgcattcacaagtacatgacccagaccgaccagggcataaacatgctaaagaacgctctgagggaaatcttccccgctgctcccatcgaggagaccttcggctacgagaccgccgcctggcgggacctgtgggggctggagaagggcaaggaaaaaggcgagcaccacaacgatgccatcgtcatcgcttcagcccgtgtcccggaagggattcccaaggcagacgcgcagcccgaggcaatatcgcagaccgttggtgggaagcgcctcttcgatctcaacccggtctcccgctcgcccaacgggcgttactaccagagaacgccggttttggccgaatccggggggataactcccaggcaactccccgccgtggtggaccagcgcaagcggaagctcctggcacgcgagttcgaacgctacgggatcgaggggaacaagaaactcccggaccgggcccgggagcgcctgcccttcaagagcgtcttgctgctcaagcgggactgcgcggacgggaatgtgcgccggatgagaaccggtcattccttcaaggtctccaatgccggcggaaccagggtcaacgaagcggtaatcgtctacgagaaccttttggggaaactatcctgttacccgctcaagaacccccgggccttcgggcctacgagaccaccggatgatttcaagagggaattgttccgattccgtgcaggcgacagaatcgttgacctcaacggaaggtccctcggggaggttgtggagtttgggagcgacggcaggttgacaacagacaaaggacataacacaatagcacacaggtgcagacgggggagttag

SEQ ID NO: 50 - DNA, 183 bp, synthetic construct
  misc_feature 1..183: note = Synthetic
  source 1..183: mol_type = other DNA
cgaggtcgaaagcagccacagcgaaggccccgcaagggcgcctgccggagaatccaacgaaaggcggaatccggccacgagctacgtttgcagggaagcctaagacctatgccgggatgtagtgactcgtctacccagccccggcctcttggagtctcggcccggaagatcaacgccctcccc

SEQ ID NO: 51 - DNA, 28 bp, synthetic construct
  misc_feature 1..28: note = Synthetic
  source 1..28: mol_type = other DNA
ctgcgagcctcgcgagcatgggattgat

SEQ ID NO: 52 - DNA, 28 bp, synthetic construct
  misc_feature 1..28: note = Synthetic
  source 1..28: mol_type = other DNA
atttcggcctcgcgagcgtgggattgat

SEQ ID NO: 53 - DNA, 28 bp, synthetic construct
  misc_feature 1..28: note = Synthetic
  source 1..28: mol_type = other DNA
atttcggcctcgcgagcgtgggattgat

SEQ ID NO: 54 - DNA, 28 bp, synthetic construct
  misc_feature 1..28: note = Synthetic
  source 1..28: mol_type = other DNA
atttcggcctcgcgagcatgggattgat

SEQ ID NO: 55 - DNA, 1470 bp, synthetic construct
  misc_feature 1..1470: note = Synthetic
  source 1..1470: mol_type = other DNA
ttgcatcataagcagctgacagtagaagctgaaagttcgtggctatccaacagcatcagggcaaaacaagaccaagtcatatcacatcttgagaagttagcgaaacatttttcaataagtgaagtgattctggaaagagcaaactttgaccttcagaagatacagggaatgattgagaatcctgatgattatatgcatgggttcaatttcggtcacagaaacaggtttgaagctttgaagcaggaatacggaaatcgttgctgcttctgtgggcaaacaggtggcgaaaaagtaaggcttcaaatcggacatgtttatccgaaagcaaaggaagaaattaaccgatgggaaaatctcattactatttgtgagaaatgcaacatcaaacaaggcggaagaacacctgacgaagcagggatgaagtttgcagtagtaaaagagaaagtcttcaatccagtacttggacaaataataactgcatcaagaacgctttcaccgaaaccactcagtgagtctaaaataaataaatacatgacacatacggatataggaataagaaaactaaagaagcaaattaattcaatgtttggagatatacctataaaagaaacctttggttatataacatcttattatcgaaatcactggggattggataaagagcattacaatgatgcgatagttgtcgcatctgaaaaaggtgatttaaacaagaagcctcaatccccatatataaagcccgttgttatcaatccgaagattaaaggcgagaaacttttcgacaccaatcctctacaacataagaatggcaagttctatcaacaaatatctttgataggcagaaaaaagagtgctcgttcttcaaatcataaagctggacagagaaaaataagggcatataatgcattacggattgaccagattgagttgattatgtctgcatggaaacggaaaatacttgatgagttaagagagaaactcggctatatgaagggagacaggaaaaaatacttcaagcccgatgacatcataaatgcaaatctgccattcagaactgtgaccatagaaaaactaggagttggcgagagtgcggtaagaaaaatcaagaataatgtttttcgtgtcgcttctgatgtcaatacccatataatggtttactccacgcctgactcaaaaatgaaagcgattcctatcaagaatacaagaatatttaaagatgttgacatgcatagagatttctccaagaaacttttcatagtaaaaaaaggagatgtagtctgctggaaaaacaaaggagtcgagattacaggtaaggtaatgaaatgcttgacaaagggtgcgagcattgatataaaggatatggattctgacaagacctacagcgctaagaaccctgtttgtattcagtcggttcgttcctctgaaggtaaattgctctttgaaaatagaaactcaagattgaaaaccgcc

SEQ ID NO: 56 - DNA, 29 bp, synthetic construct
  misc_feature 1..29: note = Synthetic
  source 1..29: mol_type = other DNA
tttcaatctcacattagtggcatttaaag

SEQ ID NO: 57 - DNA, 1920 bp, synthetic construct
  misc_feature 1..1920: note = Synthetic
  source 1..1920: mol_type = other DNA
atgccgaacgtcatggggatagatttgggcggcaaggccgtcgggctggctatcgtccagcagccggagaatcgcactctatggtgcggaacaatccatttgtcggacaagatcaaggacctctacgatctccgccgtacgctccgccgagcccgccgcagccgcgtgagataccgtaagcccaaagtcccccagcgcggcggcgggtccgccggccaatcgcaatggagcggctactcttaccgccgcgccaaaggactgaaccaatcccttcggaccaagtgcaagcacgtcgattctgaaaccggcgaggtctgcgacaagaacaccccgaagaacgccaacgtccgccacctgttcctcgacgacatccttagctacgccccatttcaagccgtgcccgatgaccacaagcagtccatccgcgaggtcctcaccagccgcgatggtatagccagccggcgcgagcgtctggcggatctccttgaccggctcaccgtcaaagcctatctcaagaagcagataaaggacatctgtttcaatgacctcgacggccgcgcggagttctgcagcgaccacatcctttgccaccacgcccagactgacgtgcccaaacagtcggcctggctgccgccctcgatccgcctcaagcaggatttcctcctgaagaacatccgcgaactggcccagcttttccacatcgaccgcatcgttctagagcgggccaacttcgacctccagaagatcgccgccggcgtgattgaagacccatcagagtaccagcagggcttccggttcggttcccgcaacacgcggatggccctgatgcaggaatacggcgcgcgttgctgctactgcggccagagcgtcgccggccagaaatggcatgttgaccacatcgacccgcgccgcgctggggaggccaaccggtgggacaacctggccatcgcctgtgaaaagtgcaaccaccaaaagggaggccgcacgccgaaggacgccgggatggccttcgccgtcatctccgagagagtcgccgggcggatgatacgccgctccctggagccccaccccatcgagggaacccggatcaacaagtacatgacccagaccgaccagggcatccgcatgctgaaaaacgccctccgggagatcttgcccggcgcagagatcgaggagactttcggctacgtcaccagcgcctggcgggagttctggggcctcgaaaagggcaaggaaaaacaagagcaccacaacgacgccattgtcatcgccgccgaccgccgcggcggcgcgaagcccatcgtcgaaataattccactggccaatcgccagatcgtgggcggccgccgcctgttcgaccttaaccccgttcagcgcgcgcccgacggccggcattatcagcggacccccgtcgcggccgaggtagggggagtctcaccgagccagctaaaggccgtggtggaccctcgaaagcgggaacttctcacccgcgaattcgcccatcacggcgttaccggcaataagtcgctcccgccggccgcgctggaacgcctgccgttcaccagcgtccggctgcgaaagccggactgcaccgacaccaacgtccgacagatcccatccggccaccgctttaagttgagtaattccggcggcacgcgcgtcaacgaggcggccgtcgtctaccgcacaacggccggcaaggtggcttcctatgtcgtgaagaaccgcttggcctttgggcagacgccccttcctggagatttcgagagggaactttggcgtgcaaaaccgggcgacgtattgtacgatgctggcggaaaccccttcggaagcgttacgaagatcggcagcaacggaaccatgaccttggatacaggaaaatcaagaatggcacatcggtgccggaagggaggaacatag

SEQ ID NO: 58 - DNA, 29 bp, synthetic construct
  misc_feature 1..29: note = Synthetic
  source 1..29: mol_type = other DNA
cgcgaggcctcccacgcacgggttgaagc

SEQ ID NO: 59 - DNA, 29 bp, synthetic construct
  misc_feature 1..29: note = Synthetic
  source 1..29: mol_type = other DNA
atcttggcctcgcacgcacgggacgaagg

SEQ ID NO: 60 - DNA, 29 bp, synthetic construct
  misc_feature 1..29: note = Synthetic
  source 1..29: mol_type = other DNA
attttggcctcgcacgcacgggatgaagg

SEQ ID NO: 61 - DNA, 29 bp, synthetic construct
  misc_feature 1..29: note = Synthetic
  source 1..29: mol_type = other DNA
attttggcctcgcaggcacgggatgaagg

SEQ ID NO: 62 - DNA, 29 bp, synthetic construct
  misc_feature 1..29: note = Synthetic
  source 1..29: mol_type = other DNA
attttggccttgcaggcacgggatgaagt

SEQ ID NO: 63 - DNA, 1155 bp, synthetic construct
  misc_feature 1..1155: note = Synthetic
  source 1..1155: mol_type = other DNA
atggaaaacgtgctggggatagatctgggcgggaagttcgtcgggctggcagtcgtcaggcagccggataatcacgtcctatggtgcggtaccctgcacctgtctgacaagatcaaggacctctacgacctccgccgtgtcctccgcagggccagacgctccagggtccgctatcgcaagccaaaggtgccccagcgtggaggcggcgcctcaggcagcggggcggacggagctacctatttctaccgtcgggccaaggggctcaaccagtccctacggaccaagtgcaagcacgtagacccacagaccggggaagtctgcggcaagaacaccccccgtgccgccaatgtccggcatttgctgctggaggacatcctgggcttcgagcctttcaaggccgtccccgaatcctaccgccaggccctgctggaagtgttggcggcaacacaaggcacgccccgaaagcagcagcggcttaagaacatccttgcccaggtggacgtggacagctatctcaagaagcaggtgatcgacatcatctgcaacgacctcgatggccgctgcgagttctgccgggaccacctgctggcccaccaccagcagaccgccgtcccgaggcaggcgtactggctgcccccatcgatcaagctcaaacaggacttcctgctcaagcatgtccgccagcttgcccgccgcttcgacatcgacaggatcgtcatcgagcgagccaggttcgacctccagaagattgccgccggggttattgacgatccaacggagtaccagcagggcttccgcttcgagttccgcaacacccgcgccgcactcctacaggagtacgacgggcggtgctgctactgcggcaaggaagttttcggtcagaagtggcacgttgaccacgtgcagccccgccgacaggagcaagtcgatcgctgggacaacctggctatcgcttgcgagaagtgtaaccatctcaagggcgggcgcgatccagaagaagccgggatgtcctttgccgtggtgactgtcaaggcagccggcaggcccatcaagcggtcattagcccccaggcccatcgagggcagccgcatccacaagtacatgacccagaccgatcagggcatccggatgctgaagagcgccctgggggagctt

SEQ ID NO: 64 - DNA, 2310 bp, synthetic construct
  misc_feature 1..2310: note = Synthetic
  source 1..2310: mol_type = other DNA
gtggtcgtgaggccacaaggcaagctggaccatattcctatccctaaacctgagcgaggaggcattacaattcggtccgagaacgtgctgggaattgacttcgggccggagcacgtggggctggccttggtgcggcgggagccggccggggagcaggtgctctacgcggcttccatcaccttgcgcgacctgtccccggtgatgaaggagcgccgcgctctcaggcggcagcggcgctctgagtcatggtaccgccagcccagggtcccacagcggggcgggggcagcgcgcggggagccggggcccaggaagatgagcaggccgtcgagggtgtgccggaagaggaggaggatcgaagtcgtgcgcggtccgctcccgagtaccggcgggcgcagggatgcaataagcccaagcgaaagtgcaagtatgttgaccctaagaccggcgaggtctgcggggccaacacccctcgcaaggagaaggttcgcgatctgctgctgtgggacatctgccagcacctgccggtggaacccgagcagcgccttgccatcctcagctacgtcaatcaggtcaatattgtccgcccggaagtgctggcgtgccttgccctggaagagcgggccttgctggaaaaccatcgagctctggcccgcgcttcgaagagcaagcctctcccccagcttctctgcgaactgaagatcaagaaacagttacaatcccagattctggcgatcgccagcggagaccccgaacgcaaagccgccgacctcaaggggcggatgcccttctgccgcaagcattttctccttcaccacgaacagaccaggattcccaagccctccgcctggcttccgcccagtatccggtgtcggcacgccgacctggagagggtctgccgggaggaggtcgccccccgctggccggtccaccggatcaggctggagcgggcgcagttcgacctgcaggccattcagcgagatccccaggggcggggtaaggactgggaccccgaggagtggcagcgaggtccttgttggggccggcgtaatatctactcggcgaagcggcatgagcagggtaatcgctgcgcctattgcggaaaaaaccccaagaaagagaaccgattagagctcgagcacgttaaaccgggtggcggcaatacttgggataacctggtgctggcctgccgtaagtgcaaccaacgcaaagggaaggctgacgccccgggtgccggtcttgagttttccgttgaccccgataccggagtgagtctggctcccaggggattgggagagtccgtggtggcccggtacatgacccagaccgaccagggataccgggagctggtggcccgcctgcagcaattgttccccgacgcccagatcgagtaccgctacggctatcagacggatcatattcgtaaacggtggatcggctcggcccagtttgcggagaccgctttgtcactcggctacaaacagtcgccgccgcggccgaagaaacgccgaaagcagtggaccgaattggcgcatctgaagcgcaaacccaggcgacacagcgatcccctcaaaagtcatgtgatggacgcggtcgccatcgctagtgccctagagctcgactctccgccgcagctttgcccggcggagaagattatccttcgcccttctcgacgccagctcttcgacaccaaccccctccagcgcggaagtgacgacaagttttaccagcgggtgaagatttgcggcacccagggcgggctggccttcgacaagctgaagcacgtggttgatgacagcaagcgggcgattctggagcgagtgcgcgaccggctgatcgagcaggctaaggtgatcgagcagcctaagggcaacaaagaatccccgcccagcgccttcaccccggatgctgcccagctgatccccttcacgtctgttcgcttggccaaacgagacgcctccaagaccaacacccggaggttaaagggcgggcactggtacaaggttgccggtgggcccaattgggccaccgtcgtctatcggcttggcgtccgtgaacaggtaatcgtgattcgcaacccagcagtgttccccgacgattcagcggaactgccgaaaggcgctcaggtgctcttttccttccgaaagggagagttggtttcctttgagcaggatgggcaaacaacgcgcgcccgaatcaccaagaacaacagcaacggcactctaaccgtcgaacgcctcgacgacggccgggaagtgacccggtcagctcgctgctttcgccccgtccccctgctagcgcccaacgcctga

SEQ ID NO: 65 - DNA, 168 bp, synthetic construct
  misc_feature 1..168: note = Synthetic
  source 1..168: mol_type = other DNA
cggagagtgaaaaaagctcagccaagggagaccccgcgggaaaccgtcaggggccaccgttaggaggcaagtttggggaataggtaggggtaaccctaagtgcaacctggggtgcgccttcagctccaggctctgcagggtccggcccagaggactaacgccctaacg

SEQ ID NO: 66 - DNA, 36 bp, synthetic construct
  misc_feature 1..36: note = Synthetic
  source 1..36: mol_type = other DNA
ctcctactctccggtaaaagggcggtgtgctacagc

SEQ ID NO: 67 - DNA, 36 bp, synthetic construct
  misc_feature 1..36: note = Synthetic
  source 1..36: mol_type = other DNA
gtttcactctccggtaaaagggcggtgtgctacagc

SEQ ID NO: 68 - DNA, 2328 bp, synthetic construct
  misc_feature 1..2328: note = Synthetic
  source 1..2328: mol_type = other DNA
gtggtcgtgaggccacaaggcaagctggaccatattcctatccctaaacctgagcgaggaggcattacaattcggtccgagaacgtgctggggattgacttcgggccggagcacgtggggctggccttggtgcggcgggagccggccggggagcaggtgctctacgcggcttccatcaccttgcgcgacctgtccccggtgatgaaggagcgccgcgctctcaggcggcagcggcgctctgagtcatggtaccgccagcccagggtcccgcagcggggcgggggcagcgcgcggggagccggggcccaggaagatgagcaggccgtcgagggtgtgccggaagaggaggaggaggatcgaagtcgtgcgcggtccgctcccgagtaccggcgggcgcagggatgcaataagcccaagcgaaagtgcaagtatgttgaccccaagaccggcgaggtctgcggggccaacacccctcgcaaggagaaggtgcgagacctgctgctgtgggacatctgccagcacttgccggtggaacctgagcagcgccttgccatcctcagctacgtcaatcaggtcaatattgtccgcccggaagtgctggcgtgccttgccctggaagagcgggccttgctggaaaaccatcgagctctggcccgcgcttcgaagagcaagcctctcccccagcttctctgcgaactgaagatcaagaaacagttacaatcccagattctggcgatcgccagcggagaccccgaacgcaaagccgccgacctcaaggggcggatggccttctgccgcaagcattttctccttcaccaccaacagaccaggattcccaagccctccgcctggcttccgcccagtatccggtgtcggcacgccgacctggagagggtctgccgggaggaggtcgccccccgctggccggtccaccggatcaggctggagcgggcgcagttcgacctgcaggccattcagcgagatccccaggggcggggtaaggactgggaccccgaggagtggcagcgaggtccttgttggggccggcgcaatatctactcggcgaagcggcatgaacagggtaaccgctgcgcctattgcggaaaagaacccaagaaagagaaccgattagagctcgagcacgttaaaccgggtggcggcaatacttgggataacctggtgctggcctgccgtaagtgcaaccaacgcaaggggaaggctgaggcccggggtgccggtcttaagttctctgttgaccccgatacaggagtgagtctggctcccaggggattgggagagtccgtggtggcccggtacatgacccagaccgaccagggataccgggagctggtggctcgcctgcagcaattgttccccgacgcccagatcgagtaccgctacggctatcagacggatcatattcgtaaacggtggatcggctcggcccagtttgcggagaccgctttgtcactcggctacaaacagtcgccgccgcggccgaagaaacgccgaaagcagtggagcgaattggcgcatctgaagcgcaaacccaggcgacacagcgatcccctcaaaagtcatgtgatggacgcggtcgcgatagccggttctctccagcgggattctccgccggagctttgccaggccgataagataaccatccgcccttcccggcgtcaacttttcgacaccaaccccctggggcgcgggagcgacggcaggttctaccagcgtgttaagatttgcgggacccagggaggcctctcgtttcgcagagttaaacacgtggttgacgctcgcaagcgggctattttggagcgcgtccgtgacctgctgatcgagcaggctaagggcaacgaggaatccccgcccagcgccttcaccccggatgctgcccagctgatccccttcacctctgttcgcttggccaaacgagacgcctccaagaccaacacccggaggttacacgcgccagacgatgatcgtctgccccagcagaagggcgggcactggtacaaggctgccggtgggcccaattgggccaccgtggtctatcggcttggcggccgtgaacaggtggcagtactgcgcaacccggcggcttttccagacgcttcttcggacatcccggcaggcgctcaggtgctcttttccttccgaaagggaaagttggtttcctttgagcaggatgggcaaacaacgcgcgcccgaatcaccaagaacaacagcgacggcactctaaccgtcgaacgcctcgacgacggccgggaagtgacccggtcagctcgctgctttcgccccgtccccctgctagcgcccaacgcctga

SEQ ID NO: 69 - DNA, 167 bp, synthetic construct
  misc_feature 1..167: note = Synthetic
  source 1..167: mol_type = other DNA
ggagagtgaaaaaagctcagccaagggagaccccgcgggaaaccgccaggggctaccgtcaggaggcaagtttggggaataggtaggggtaaccctaagtgcaacctggggtgcgccttcagctccaggctctgcagggtccggcccagaggactaacgccctaacg

SEQ ID NO: 70 - DNA, 2067 bp, synthetic construct
  misc_feature 1..2067: note = Synthetic
  source 1..2067: mol_type = other DNA
gtgagtacgagtgcaggcgagtgtgtgctcggcctggacttcgggccgaagcacgctgggctcgcggtggtcctgcggggtccctcggccgacgaagtggtgttcgccggggaggtgcgtttgcgcgccctgaaggccttacgctctgaccggaaaaccccactctccgagcggaagaccatactcggcgtccggcgggccttgcgccgcagtcgccgcagccgcaagcgctaccgccagccgaagattccccagcgcggcggcggggccaccacagataccccggagaacaccagtgccgccaggggccgccctcccgagtaccgtcgcgccaccggcctcaacacaggccgaagacgctgcaagttcacggaccccaccaccggcgaagtctgcgccgtgaacaccccccgcaagaccaacgtgcgcgacctgctgctctggaacatctgccgtcaccttcccgtgtctcttgcagagcgcgccgcctttgtgtcctacgtcaaccagcgcaacctccaacagggtgaagtgctggacgcgcttccggcagcggaccaggccgcgcttcaggccgtctttgctcagcagcgcaagcccaagcaggaaccccttgccgcgcgaatgcgtcgcctgggagttgaccgccacctgcgctcacagatcacggacattgtgggcactacctcacgccggcccctcagcggcaggctctcgttctgtcggcagcacttcctccgccaccacgagcagacccgagtagcccgtccgagcgtgtggcttcctactaccatagagatgaagcacgcggatgtcctccgcgtgtgcggccaagagatcgcgcccaggtggcaggtgcgccgaatcgtgctggagcgcgcgggcttcgaccttcagctcctgcggcagcaagtatccttggagtggagagtggaggactggcagcgagggccccgctggggctaccggaataccttcgaggcgaagaagcaggaccaaggcaaccgctgcgcctactgcgggaagaagccgtcacgcgagaaccgatttgagctggagcatgtggcccctggcggcggcgattcctgggagaacctggtgctcagttgccgcgcctgcaaccagcgcaaagggagtcgaagtcccgccgaggccggaatgctcttctgggcggacaccgaaaccggagagaccctggccccgctatctctcggcctgtcacgcgtggcccgctacatgacccagactgaccagggctggcgcaggctggaggcttcgctgcggaggctgttcccaggtgcagaggtggagtacacttgggggtatcagactagcttctaccgcaaccgctggggcctgcccaagaagcactacgctgacgccgcggtcattgccagctctcaccaactggagcgcaagctcgcgcttcccgagcagccgaagcgcttcgcgcccgcgccaggcggcaagcggctcttcgacacgaacccgctcgcgcgcgaacccgacggccacttcacccagcggcagaagctggtgagcgagcagggagggctgacgttcgccgaagtcccacgcgtggagaacccgcggaagcggaagctactccaggccgcagccgacaaggcaatagccgaggccgccgccaaaggagagaagccgccggcggcgttcactgcggcgatgcttgctggccttccgttcaactcagtccgcctcaccaagcccgacgcgcaggagcgcaatacccgacagctagggcagcagtggttcaaagtcgcggggggccccaacgtcgccaccatcctctacgaacacaacggcaaccaggccaccctcgtcaaacggaaccccgctatcttccgcgctgacccaggcctgcccagaggggcgcgcgttcttgcggtctaccgcaaaggtgacttcgtggagtgcagcgacggcctgggccgggtgacgaagaaccacagcaacggcactctaactgtcgaactggtggatacaggaaaggcggtgacgcggcaggccaagtcgttccggccggcgcgcaagccgccgcgaggatag

SEQ ID NO: 71 - DNA, 220 bp, synthetic construct
  misc_feature 1..220: note = Synthetic
  source 1..220: mol_type = other DNA
gaagggcgaaaacagcccagccaagactcgccgcggacaggcctggtagcacaggactgagccggtgtggcgagcgcgggaaaccggcggggaaactcggccggctaccgtcaggaggcacgtttggggaacaggtaggggcaaccctgagtgcaacctggggtgcaccttcagctccaggctctgcaaggctcggcccagagggactaacgccctaatc

SEQ ID NO: 72 - DNA, 28 bp, synthetic construct
  misc_feature 1..28: note = Synthetic
  source 1..28: mol_type = other DNA
tttcgccctcgcgctggtggacacggtg

SEQ ID NO: 73 - DNA, 28 bp, synthetic construct
  misc_feature 1..28: note = Synthetic
  source 1..28: mol_type = other DNA
tttcgccctcgcgctggtggacacggcg

SEQ ID NO: 74 - DNA, 28 bp, synthetic construct
  misc_feature 1..28: note = Synthetic
  source 1..28: mol_type = other DNA
tttcgccctcgcgctggtggacacggct

SEQ ID NO: 75 - DNA, 28 bp, synthetic construct
  misc_feature 1..28: note = Synthetic
  source 1..28: mol_type = other DNA
tttcgccctcgcgctggtggacagggcg

SEQ ID NO: 76 - DNA, 1920 bp, synthetic construct
  misc_feature 1..1920: note = Synthetic
  source 1..1920: mol_type = other DNA
atgccgaacgtgctggggatagatttgggcggcaaagccgtggggctcgccgtggtggagcagccggacaaccgcgttgcatggtgcgggaccgtccacctttccgacaggatcaaggatctgtacgaccagcgccggacgctgcgccggggccggcgctcacgcgtgcgttaccgcaagcccaaagttgccgaacggggtggcggctcggccggtcagactcagtggagcggattcaaataccgccgggccaaggggctcaaccagtcactccggaccaagtgcaagtacgtcgaccgggaaaccggcgaagtctgcgaacggaacacgccaaagaaggccaatgtccgccatctccttatccaggacatcctgagctttcagccgttcgccgaggtgccgccggatcacagacaggtcatccgcgatgtccttgcctcgcgcgaaggtgcaggaacccggcgtaagcggctccagaacatcctcagccggctcaacgtggacacttacctcaagaagcaggtcgacgacatctgcttcaacgatctccccggccgggccgaattctgccgcaaacacatcctcgctcaccatgagcagacggacataccggcacaggccgtttggctcccgccatcgatccgcctaaagcaggactttgtcctgaagcagattcgggttctgtcgcgccgattccgtatcgacaagatcgtcatcgagcgggcgaacttcgacctccagaagattgcggcgggagtgatcgatgatccggcggaatatcaggaaggtcaccgctacggcttccggaacacccgcgcggcgatgatgcaggagtacggggcgcggtgctgctattgcggcaagagcgtggtaggcaagaagtggcaccttgaccacatcgagcccaagaagaccggcgagatcaaccgctgggataatctggccatcgcctgcgaaaagtgcaatcagcggaagggcagcaggacacccacggaggcgggcatgtccttcgccgtcgtttccgaaaacatcgcgggcaggcggatcaggcgctcattggcgcccaagcccgtggagggcggccgcatccacaagtacatgacacagaccgatcaaggcatccgcatcctgaagcgcaacctgggggcaatcatcccccatgcacccatcgaagaaacgttcggctacgacaccgcggcctggcggggcgtgtggggcctggagaaaggcaaggagaagggggaacatcacaacgacgcaattgtcatcgcctcgctgcggtcaccggaggcggggccgatcatcgaagtggacccggaagtgagccgccaggctgtcggcgggaagcggatattcgaccagaaccccatccagcgcgcaggcgacggcaaccactatcagaggatcccggtcgtcgccgaggtcggcggcatcacgccgagacaactccgggccgtggtggacgaacagaagagggcgctcctggcacgcgagttcgagcggctcgagatcaaggggaatcggtcgcttccggatagggcccgccagcgcttgcccttcaagagcgtccgcctccgcaaaagagactgcacggacgagaacgttcgcacgatgaaaagcgggcaccgcttcaaggtctccaacgtcggcgggacgcgcgtcaacgaggcactggtcgtgtaccgcacacatgcggggaaggtagcgtgctatccgatgaagaaccggcgtgccttcgggcctacacttccgccagcggactttgaaaaggagcttaggcgtttcaggcccgccgacgcggtatacgaggctggggggaaggaactagggcggatcgtcgttctctggagcagcggtcgcgtgaagctggacagtggggtaaccagggcggcgaccaaatgcttgaaaggaggtggttga

SEQ ID NO: 77 - DNA, 185 bp, synthetic construct
  misc_feature 1..185: note = Synthetic
  source 1..185: mol_type = other DNA
ctaggtcaaaagcacgcctcagcgattccccgactgttcggggaagccagggaacccaacgaaaggcgggacctggccaggagctacgtttgcaggacagccaaagacctatgccgggatgtagtgcctcgtctacccagtcccggcctcttggagtctcggcccggaagattaacgccctcgcc

SEQ ID NO: 78 - DNA, 24 bp, synthetic construct
  misc_feature 1..24: note = Synthetic
  source 1..24: mol_type = other DNA
ggtcgcagcgtgcatgggatgaat

SEQ ID NO: 79 - DNA, 24 bp, synthetic construct
  misc_feature 1..24: note = Synthetic
  source 1..24: mol_type = other DNA
tggcctcgcgtgcatgggatgaat

SEQ ID NO: 80 - DNA, 12750 bp, synthetic construct
  misc_feature 1..12750: note = Synthetic
  misc_feature 1..6024: note = n is a, c, g, or t
  source 1..12750: mol_type = other DNA
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggtggtcgcggcagcggttgtcgaagcgggtggtgatctcgacgcagcgcccgcccttgcgcagggttacttccgaaacgatccgcagcggcaaggtttgctccgagcgcgaggcgcagtcgccgtcgccatcgaggcggcggacgtcgctgccgtgcccctcgaccaggtgttcgggcgcgtcaatcacctggtcaatccgatacgtcgccagcagcggcccggcctcttttacggtgacgctcgcggcggctccgcgggtggtgatgacgcgatcgaacgcggggggcaggtgacgccaggcgtgcccggcctcgccgccgtcctcgaagtagtggaggccggcgaaggtgcggccggtctgcttgtgggtgacgtcgagggtgccgtcgccgttgacgcgcacgcgcaggtgctcgttttccatcgtccgctcatcggtcaccaggctgccgggcaagcggtcggcatgctcgcgggggcggaggaggtaggtgcggtagccaagcgcgggcagcgcctcggcgttgaagcgcacctggacggtggtggaagacatctcgctggtggcgtcgccgaggtggcgcaccaccgccatgcggtcctcgcgcgagacctcctgcgtctcgacgcgccgaccgctggcctcctcgatgaggtcgaactggttgatgccgagttcggccggcaggtcgaggtaagcgctcagcacctcggagcgctcgcggggcgaggggttgaaggcggtgagcaggatcgcatcggcgccgagatgggagtgatccacccggcgggcgagggcctgaaagctgcggcgcatcaggctggcggcgatgccgcgcacctggtcgaggcggtggtgcatatcgcgctcgatctggtccaccccgctgccggcgatgctgtcgtgggcgtggcagcgcagcagatagcgccaggcgatatcgagcagcgacttgggatactcctcgcccagcagccaggccagggcggcgaagggttccgcctggcgctgcagcgcgtgctcggcgaggccgttggcgcgcttgacgcgcacgcggctggaggtgacgtcgccgaacaggtgcacgcgcgtgcccagctcgcgcggggtgcggcgctcgccgcgcagcacggtcaggtccttcgcctgcgccttgaccttggccagccaatcctccagggacgagtgcatgatccggtccggcgcgacgatcccctcggcctgggcgacgatctcgacctcgcgcgggtcgggctcggtggagtccatgcccatcatgcaggcgatgtagcgggtggcggcgtgctcgcgctcgacctggcgcaggcgatggaggccctcgaccagcttgtcgcggtcgaggcctttgcgcggatcaaccaggaagtggtgtgagcgccatttccccgggccgcagaggtgaaagggcaggccgccctcctcccagaggtagcggcgctccatgatctgcttgccgtaaaccgcggggcgaaagacctggtagaagaagttgtagcgggcgaaggagcccatgcgcgagccgaagaggcgcgagccgtcggggccctcgaggatgaactcggagcgggactcgtcgggcgtgatgccgtgatagaagaggatggtatcaatgccgaagccggagtagatctgcgccatctgcgaggcctggccgtaggagaaggggctgtagccgaccttcatcacgcggccgaagctctcggcgacgacgtggccggccagcaggttgcgcaccagcgattcgccgttgacgttgaactcctcggggcaggtgtaccaggggccgatgtgcaggcgctgctcgcgcaccaggcgggcgatgcgctcgcgctggtgggggcgcacctccaggtaatcctccagcggaacggtctgcgaatcgagcaggtaggagcggtagcgcggctcggaatcgagcaggtcgagcagcttgtccatgaactcgaccaggagcatgcgcgtctcctggaagtcgtaaagccactcgcggtcccagtgggtgttggagatgacatgaagctcaagtgtctcttcaggcataatgacctccagatctgattgtccgcaggcttcacagatttcgcgcatgagggcattgaaccacagagaacccttcgacttccctcagggtaaactccgagggcgcagagacagagtttagccgccgatgaacgccgatcattatccgttccgtcctctctgtgttctcggtgccctctgcggttcagattattgcaatccgcgcaatctgcggcatctgcggatgaatctccctgcgccggggagggcgctttcgccgcggccgcgcacggctcctgtaagggcaggagccgcccatgcgccggcagaatctacaacctatggcagccccttccctgtgcgacaagatagtctcccgcgagcgggcggcgcaggcgatcgctgatctgcgcgcccggggccagcgcgtcgtcttcaccaacggctgcttcgacctgctgcacgccgggcatgccctctatctcgagcgggcgcgggcgctgggcgactgcctcatcgtcggcctcaacagcgacgaatcggtggttgccctcaaaggccccgcgcggccgatcgtgaacgagaccgagcgcgcgcagctcctggcggcgctggagagcgttgacttggtcatcatcttctccgagccgacctcggaggcgctgctcgacctgctgcgcccggaggtgttcgtcaagggcggcgattacacgcgggcgacgatgaaccaggaggagaagaacttcgtcgagtcctacgggggcgaggtgcacctcatccccgcgctgcccgagagctccaccacgcgcatcatcgaacgcatcgtgaccgcgcacggggaatgacggtcccgccgggaaccgagcgcgaggccgccgggtgtgtacgagtttcgttcgtgggatcgccgggcagggcgcaaaccaacgctgcgcgaacacacccgtcgttgctccccgcgcagtcacaagttcggttgaccaacgggctaccggatggtatacttgcgttggtatagcgtaaccgctccttgacaatcaagcctctgacacaggcaattacgcgagctgccaggagagtgaggcctgaagaacgagctgctgccaaaaggccaaagccttgtcaaggcgagaagtcaagcgtatttggagtggagcatcggactcctactctcgtttcactctccggtaaaagggcggtgtgctacagcacggcagggccgtggacgattgaacagcctgtttcactctccggtaaaagggcggtgtgctacagcatacccggctaaatcaacagacggcccctaggtttcactctccggtaaaagggcggtgtgctacagcaggggcggtggatgctcctatgctgccagagtttcactctccggtaaaagggcggtgtgctacagcttgagaatcatgcggtggagatggattctggtttcactctccggtaaaagggcggtgtgctacagccaccgaatagtctttgtacgtgccggggaggtttcactctccggtaaaagggcggtgtgctacagcgaccaacgacgtgcatgatgtagcgatctagtttcactctccggtaaaagggcggtgtgctacagcgcagtgcttgcaagggcatcgctcactctcgtttcactctccggtaaaagggcggtgtgctacagcagagcgaggctgactgaattcggggaagtgctgcaaattcgacgctggaaggccctgtttcaattgtcggagagtgaaaaaagctcagccaagggagaccccgcgggaaaccgccaggggctaccgtcaggaggcaagtttggggaataggtaggggtaaccctaagtgcaacctggggtgcgccttcagctccaggctctgcagggtccggcccagaggactaacgccctaacgtgaagtcgagggagagaaaggtggtcgtgaggccacaaggcaagctggaccatattcctatccctaaacctgagcgaggaggcattacaattcggtccgagaacgtgctggggattgacttcgggccggagcacgtggggctggccttggtgcggcgggagccggccggggagcaggtgctctacgcggcttccatcaccttgcgcgacctgtccccggtgatgaaggagcgccgcgctctcaggcggcagcggcgctctgagtcatggtaccgccagcccagggtcccgcagcggggcgggggcagcgcgcggggagccggggcccaggaagatgagcaggccgtcgagggtgtgccggaagaggaggaggaggatcgaagtcgtgcgcggtccgctcccgagtaccggcgggcgcagggatgcaataagcccaagcgaaagtgcaagtatgttgaccccaagaccggcgaggtctgcggggccaacacccctcgcaaggagaaggtgcgagacctgctgctgtgggacatctgccagcacttgccggtggaacctgagcagcgccttgccatcctcagctacgtcaatcaggtcaatattgtccgcccggaagtgctggcgtgccttgccctggaagagcgggccttgctggaaaaccatcgagctctggcccgcgcttcgaagagcaagcctctcccccagcttctctgcgaactgaagatcaagaaacagttacaatcccagattctggcgatcgccagcggagaccccgaacgcaaagccgccgacctcaaggggcggatggccttctgccgcaagcattttctccttcaccaccaacagaccaggattcccaagccctccgcctggcttccgcccagtatccggtgtcggcacgccgacctggagagggtctgccgggaggaggtcgccccccgctggccggtccaccggatcaggctggagcgggcgcagttcgacctgcaggccattcagcgagatccccaggggcggggtaaggactgggaccccgaggagtggcagcgaggtccttgttggggccggcgcaatatctactcggcgaagcggcatgaacagggtaaccgctgcgcctattgcggaaaagaacccaagaaagagaaccgattagagctcgagcacgttaaaccgggtggcggcaatacttgggataacctggtgctggcctgccgtaagtgcaaccaacgcaaggggaaggctgaggcccggggtgccggtcttaagttctctgttgaccccgatacaggagtgagtctggctcccaggggattgggagagtccgtggtggcccggtacatgacccagaccgaccagggataccgggagctggtggctcgcctgcagcaattgttccccgacgcccagatcgagtaccgctacggctatcagacggatcatattcgtaaacggtggatcggctcggcccagtttgcggagaccgctttgtcactcggctacaaacagtcgccgccgcggccgaagaaacgccgaaagcagtggagcgaattggcgcatctgaagcgcaaacccaggcgacacagcgatcccctcaaaagtcatgtgatggacgcggtcgcgatagccggttctctccagcgggattctccgccggagctttgccaggccgataagataaccatccgcccttcccggcgtcaacttttcgacaccaaccccctggggcgcgggagcgacggcaggttctaccagcgtgttaagatttgcgggacccagggaggcctctcgtttcgcagagttaaacacgtggttgacgctcgcaagcgggctattttggagcgcgtccgtgacctgctgatcgagcaggctaagggcaacgaggaatccccgcccagcgccttcaccccggatgctgcccagctgatccccttcacctctgttcgcttggccaaacgagacgcctccaagaccaacacccggaggttacacgcgccagacgatgatcgtctgccccagcagaagggcgggcactggtacaaggctgccggtgggcccaattgggccaccgtggtctatcggcttggcggccgtgaacaggtggcagtactgcgcaacccggcggcttttccagacgcttcttcggacatcccggcaggcgctcaggtgctcttttccttccgaaagggaaagttggtttcctttgagcaggatgggcaaacaacgcgcgcccgaatcaccaagaacaacagcgacggcactctaaccgtcgaacgcctcgacgacggccgggaagtgacccggtcagctcgctgctttcgccccgtccccctgctagcgcccaacgcctgacgccttgtctgagcacccgccagtgcccctcgcacagctccctccaactgcgcccgcagcatctcctcctgccagggggcgagcgcctcggtctcgcacgctgtcaccgtccccggcggccgctgccggagaccgagcagcggcccggtttcgggcggcagtatgtgggcacgttgacggcggtgctgctgccggtgacggcgctgctgctggttgccgcgattggtttccaggtggtcttcgcttcccagagcctggtcctggcgaagagggagaaggtggagatctaccagagcgagttggcatactacggtttgccgcggccgctttccgggcggtgaggcccgggccggtcgccgcgccaggagaaacggccgtccgcggccaagatatccctggggcaggaggcaagctcctgcccta

SEQ ID NO: 81 - DNA, 14406 bp, synthetic construct
  misc_feature 1..14406: note = Synthetic
  misc_feature 1..5667: note = n is a, c, g, or t
  source 1..14406: mol_type = other DNA
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggccctggcgcaggcgatcaacgacgccacggccgccatcatcgtccagagccccaacttcttcgactgcatcgacgacgtgagcgacctcgccgacctcgcccaccggcacggggcgctgctgatcgtctcctcgtacccgatcgcactggggctgctcaagcccccggggcagatgggcgccgatatcgtcgtcggcgaagggcaatcgctcggcatgccgatctccttcggcgggccgtacctgggcttcatggccacgcgcaagaaactcgtccgcaagatgcccggccgcgtcgtcgggcgcacagtggacacgcagggccgtgagggattcgtcctcaccctccaggcccgcgaacagcacatccgccgcgagaaggccaccagcaacatctgcacgaacgagggcctgtgcgccctgacggctgtggcgtaccttagcctgctgggcaagcacggcctgcgcgacctcgcccagacctgcgccgacaaggccgactacgcccgccaccgcctgctccaggtgcccggcgtcaccatgcggttccccaaccgctggtacttcaacgagttcgtcctgaacctgccgatggcggccgacaaggtcatccgcgggctgttcacacgcggcatcgcggccggcttcccgctcgggcgctactggcccgagatgaacaactgcctgctcatcgccctcaccgagaaacggaccaagcaggacattgacttcctcgcccacacgctggaggtgatcctgtgaagctcatctacggaaagagcgttccgggtcgccgaggcgtccgcccggtcggaagcgacgtgccgacgaaggccgagattcgcaagaacctgctgcgcgaggagcccgcggcgctgccggaggtgtcggaactcgacgtcgtgcggcacttcacggagctgagccgccggaacttcggcgtggacaccggcttctacccgctcggctcgtgcacgatgaagtacaacccgaaggtcaccgagcggatcgcccattaccccggcttcgcctacctgcacccgctgctgccgcaactgcccggcggcgagacgatggttcagggggcgctcgcggtgctgcaccgcatggacctgctgctgcgggagatctgcggcatggccgcgttcaccatgcagccgctcgcgggcgcgcacggggagctcaccggcgtgatgatcatcgccgcgtaccacaaggcccgcggcaaccgcaagacaaccatcctgatccccgacagcgcgcacggcacgaaccccgccagcgccgccatcgccgggtacggcgtgcggacgatcgcctccgacgccgacggcgtcatggacgccaccgccctccgcgaggccctccacgacggagtcgccggcgtcatgctcacgtgccccaatacgctgggcctgttcaacccacgaatcaagcagatcgccgacctcgtccacggcgtggacgggctgatgtactacgacggcgcgaacctcaacgccctgctcggcaagtgccgcccgggcgacgtcggcttcgacatcgtccacgtcaacctgcacaagacgttcggcacgccccacggcggcggcgggccgggcgcggggccggtcggcgtcgtcgagaggctcgtcgagttcctgcccacctccgtcgtctgcgagcgcgacgacggctcctactacctcgactacgcccggccgcattcgatcggctacgtcgcgccgttctacggcaacttcgcggtggtcctgcgggcctacgcgtacatcctcatgctcggccgcgaggggctgctgcgtgtcgcggagaacgccgtgctcaacgccaactacgtgctggccaagttgcgagagcggtacgacgtggcggtggaccgcgtgtgcaagcacgagtgcgtgctgtcggcctcgcggcaggagaaggccggcgtgcgggcgatcgacatcgccaaggcgctgatcgaccgcggcttccacccgccaacggtttacttcccgctgaccgtgcccgaatcgatgatgatcgagccgaccgagaccgagtcgaaggaaactctcgacgccttcatcgccgcaatgttggagatcgccgatctcgccgagaaggaccccgagtcgctgaaggcctgcccgcggaccacgcccgtcggccgactcgacgaaacccgcgccgcccgcaagcccgacctggcatacctgctctgagcgagggcggcatggcggccgttgtctgccgccatgctcctccggcgaagcaaaagcgaggacgattcctgtttccgcggcacggggcccccttccccgggttatactgctggtcgcggccggaaggcgcatcccgttccgccgcgacgacctgccgactgacgcgacccgcccggagaccacgacatgcgaccatcccgacctgccgtttgtctcgccttggccctgcccgtagtcgccctgtccgccggatcctctgaagcgggcatgttcggcgccccgcccatgcggacctcggccgccgccgataccgaccacagcacacccgcccacgccccggacttcggcagcagaaccctctggccgcacgttacgggcgacgaggcatacgtcaagcagacctggcccaaggcccgcgtcctcgtctggaccggcggcaacggcaggttcgccgacgccgccaactggctcgaggacggcaagcccgcccaggccgccccagaccgcaacaccgacgtcgtcttcccaccggccaaggcggcgtacaaggtcgatgcctacaagcagcactgccgacacatcacgatcggccgcaacgccagtgtcgagggccgcaacggaaactccacccgctacctcaatgtctggggcaacatctggattcacgccggcgggcgcgggttcttcatcgcgccggtcggcggcggcaacaccttcttccgccgcgacggcgagctacagaaggacaacagaggcaaacgcatctacgacttcggcttcggcgacaaggcgacgatcaccaagtacggcggcgccagcgtcgaaatcctcggcgtcctgggcacgaacgacgagatctacatcgcctccggcaagacgatcctcggccccacgtgccggttcatctacagcgcgatgaccggcaacggcacgttcgaggtctatgacggggcgaccctggagcttcagtcgggcgcggttctggctatcgaccgcgcgagcgtcgagtacaacgtgtcgatctacaccggcggcacgctccaggccggctcgcccaagcgtccgctcacgcgcgacgctttcctccgcatggccccgggccggcgcggcgggctgttcctcgaacccggtgccagactccgcgttcacagcgccgaaccggccgaggcgcgcctcgtgttcgagtccacgcaacccgggaagaggctctccgccaagggcgtcaagatggtcttcggcggcgatgctcacatcgacggcgccgtgttcgaccagtgcgaggccggcggcgtcgaagtcacagaccttgccgtggtgaagggctggaagcacgtcacgctcgggccgaacaacctcgccaagggccagggcatcttcgcgaagatctccggcaaactctacgaccgcgggcccaagaagcaccgcatctacgttaagccctgcctggcggccatgaagcagttccaggcagaggacgccgaatccggcaaggacgacagatagcgtctcgcgcccctgcggccggctgggggctggttgaacgccccccgcccagccgatagagtgaagagcgttaggcgcctgtagctcaaccggatagagcagcggtcttctaagcaaattgcagcgataggcgcgaatcacgggaagtggcggaaacgccgacgggcgcgtattttcggggccttgactccgcggcttcgatctcgtcaaaggccgggaaatcggcctcggcaaccgtagaaccgtagcacgtcggccaacggtgtgcgcccggaatcggcgcgggcgccggggggatccagaccggctcgggcggggatcggcgcttgtggggccgcgtgcggcgtcgggatcgcgggaccgggatcgtcgctctccggcgatcctcgcggcgtggcgggccgcgtggtgagcgttcagaccgggcgccgggccgtgcccagccgtcggccgggatcgcggctctcgcgggcaattaggcttggcggcgccgccggctgcccgcttccgatgctaggaccccgaagcccagacgcggcccaactgcagcgcaaggaagcccgttgccacaatccaggtcacgtggtatgatgtttgcccgcaactgagattggggccgaatggcaaacgtccttgggatagacctgggcggcaaggcggtggggctggccatcgtccagcagccggagaatcaggttctctggtgcggcaccgttcacctctcggatcggatcaaggacctctacgaccaacgccgcgttctgcgccgcgcccggcgctcccgcgtccgctaccgcaagccgaaggtccagcagcgcggcggcggctccggcggccggggaaccgaaggcgccacctacttctacaagcgtgcgaagggcctcaatcagtcgctccgcagaaagtgcaagtacgtggaccccaacaccggcgaagtctgcggccgcaacacgcccaagcgaggcaacgtccgccacctgctgatcgaggacatcctgagcaactactcgcccttcgccacagtcgatgcaacgctgaagcaagcgattcgcgacatcctcgccagtcgcgaaggaatcactcgccgccaggagcggctcaagaatgttctcgacctcatcgacatcaacgccgacctgaagaagcagatcaccgatatcttgtttggcacaggcgagcgccgctgtgagttctgccgcgaccatatcctctcccaccacgagcagacgcagacgccggccgatccccgttggctgccgccttcgatccggctcaagcaggagtttctcctcaagcaggttcgccgcctcgcgcaccgttaccgcattgaccgcgtcgtcatcgagcgggcaaggttcgaccttcagaagatcgcccgcggcgtcatcgacgacccggccgagtaccagcagggccaccgatacggcttccggaacgtccgggcggccctctttcaggagttcagcggccactgctgctattgcgggcggagcgtcattgacaagaagtggcacgttgaccatgtggacccgcgccgcaagacgggggcggggcggtgggacaacctggccgtcgcctgcgagtcctgcaaccacacgaagggcggccggtcgccgcaggaagcggggatggcgttcgcgaccatcccggcggtcgtcgcggggcgccgcatccgccggtcgctcgcgccaaaaccgattgaaggcgcccgcatccacaagtatatgacgcagacggaccagggcatccgaatcctcaagcgcgagctgcgggaaatccttggggccgtcgagatcgacgagacgttcggatacgtcacgagcgcctggcgagacctgtgggagttacccaaggggcgcgagacgaacgaacaccacaacgacgccatcgtgatcgcggccaacctcacgccggatgcccgccccaagctcgacggcgagccggaagccgtccggcagttgatcggcggcaagcgactgtacgatcagaaccccgtttcccggcggggcgacgggaagtactaccagcgtcagccggtgctggccgagcaaggcggcatcacgcgccggcagcttcgccaagtggtggacgagcgcaggcgacgtatcctcgccgccgcgttcgagtaccacggcgtcaagggcaacaagacgctgccgcccgccgcgctccagcagttgccattcaagagcgtgcggctgcgcaaggccgactgcaccgatgagaacacccgcgctctcccggcccggaaccgccggcatcgctacaagatctccaacacaggcggaacgcgcgtgaacgaggcagtggccgtgtatcaaacgaccggcggtcgccgggcctgctacgccgtgaagaaccggcgcgtcttcggacggacgccgcccccggaggacctcgcgaaggaactgtggcgcgtgcggcccggcgatacgctccacgattcgtcgggcgacgtgctgggcgccgtcgtgaagctgggaagcaacgggacgctgacgctggatagcgggagaacccgaatggctcaccgatgccacagggcgatcagcccctgagatgagtcggacacaaacgggcgagtgtgcgcccgcgttgctgcattgacaaccgaataggtgcctgcgtagcgaacgctgacccgcgtgcgtgggagtgatcgcgtcgccctctgcctctggcgcgagcatgtgattccggactcgcgtgcgtgggagtgattgattgagccacgtcgtcgggtgcgggacgaacattccggactcgcgtgcgtgggagtgatttctttggcttggtcatggctcgaccaccttgaattccggactcgcgtgcgtgggagtgattggaaccatgaccaagccaaagaagcgtacatgcattccggactcgcgtgcgtgggagtgataataatccgccaactcacacgcttccagcaggtcattccggactcgcgtgcgtgggagtgatatcgtaatagaccttcagcgggaccgcgacctcattccggactcgcgtgcgtgggagtgatcgaccatcgaagcccgcccgttgcgggccaaccattccggactcgcgtgcgtgggagtgatactggcatcttgcggaccggatgccggcgaagcacaagatgatgttgttcaggccaaagctagtgtccccgcgggtccggacgcgaagtatctcccacggaagcgagttcggaagcagcctcagcgatcccgagagatcgggagccagggaacccaacgaaaggcgggacctggccagaagctacgtttgcaggacagctgaagacctatgccgggatgtagtgatctcgtctacccagtcccggccccttggagtctcggcccacaagatcaacgccccagcggttcggccgggggaaagaaacgtcctcgtgaggggacatcgccacggcgacgcccgcccaacggcgggcgaggcaagccgagacatgtgcgacctgcaaaccttggctggggatagacgggagttcttttcccgcgctgaagcgtgcggggcgaagtggagcgcgccgggtgtgcgcgccgactgaacggtcaagatggaccctgaaggaagaagcgaagaagacaagaagaaggaagcggaaggctattgggagccttacgcgtatttcgcgcgcgctgtccgcctttggttcctggcgtacggcgttggctttccgatcgccatcatctcaaacgagtggttgctgaagcgattgcgcgcctcaggttgtctggcgacggtggcgtggctgttcatagccggggtggtggtgcaggtcctcgccgcgatgttctggcgcacgtcgatgtggtaccagtacctatgcgagcctcgtgggccgaaggtccgccggcggcgcgcgtggatgtttagggcttcaagatgggtatccgagcagtactggatcgagttgatccccgacattgctacgctggtgttattcgcccgcgcaacagccacggcgctgcgcgtcatctgctcggattgagggcgtgtgttccgcatcgcacgccgccaaggggcacgagggatccctccggcttgccgccggtcagaagcgcgaacaggcgggcgacttcttcgccggcggcgcggatcgcggtcggggcgttgttgcggtgctggccagcgggatcgcgtctgtgcgggccgcccagggcggcggctacgggggcggcggggccgcgtcgcgttcgcgattggccgggcagtcggcaggcagcggataggccggatcgccggccagcgcgcggcggcgcttgcagccgggaaggtggccgacggcgcaccagggccggcgggcgcagccgatgcaccgatccggccgcgcggggcgcggggaaggcgcgggcgagtggggtcgctgttgggggcggggcaaacgttccgccgtgaacccctccggacactcgtccggaaaaccgacggccgcccgctgggccgggtccgtacggcaggcccggcagtgcaggcggctggcgcacgcttggcgaacggcaggactcatgggcacccgcccagggtgacgttggcggtgcagccagaacagtcctccccgccgctgccgctcaggtcgattccgtcgagactgaacgagccggtgagctggtagccggacgggtcgcactccctgcaggcgattccgtccacgtcctgccagtaatagctgccggggttgctcgcgggcgccgttccgtactgagataccgggctggagcagccgagccgggccttccattggtccgcgacgatgtcgtacaggacgtacaggtagaacgtgccggtcccgttcttgcacttccagctcgtccagcagtagttcccctcgtcgcgataccgggccgcgtagctgtacgtgcccgcggcgttgcagtcgccggcgcatgccccgtccacggtgacgacagcgtccgtatgggatgtgtgatagcagccgtcgcaagggtccgcagcgcaggcgttgaccaggtggccgccggagcctttgagtagatggccgctggggcctttct

SEQ ID NO: 82 - DNA, 16188 bp, synthetic construct
  misc_feature 1..16188: note = Synthetic
  misc_feature 1..5585: note = n is a, c, g, or t
  source 1..16188: mol_type = other DNA
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcaggatacgatactgttttttataactcgtcaaatctggataaactgattgagattgcttcaagagaaagtcgcacaattttaaccagaaatagcggtttcataaaaaaagagagaaaggttttagaggaaagaggtatcccacatcttttattggcatctgacagtgttgaagaacagcttaaagagacagtagattattttaaacttgacctgaaggagagttcttttacactctgtgtggattgtaataagccgttttttaaaatatcaaaagaggatgctttgggtaaggttcctgagtttgtttatcaaaattacaatgaatttgtccaatgcacaaactgtaaaaagatattctgggaagggacacatagggaaaggatggaggaaatgcttaaaagagtgtattgataaactaatgaaaggttatattgtttatataacctatctttccgttttgtccaagacggtagaaatgccttatatcttttaataaagaggagatatcattcctttttaaataatttgtttctaaatagtgacagtagttcattgccattctgtttgcatccctgtatctttctttttcctctgataataaatccggatttagtatagaattttcaaacaactgtctctttatactttttgcagggactctgccggaattaatactgctgctgtagaaaatggctgtgatatatttatcaacctcagcctgaagctccatctcaaagatagttatctgtcttttatggatggcattccatactgcatatatgaaatggcttatctcctctgtggcaagaaaaaaatctgaaagatttattttgcagaaatctttttgcagatgaatattttttagattagatagtgtctctctgccgagatatacagctattttgagttcatcgtcattctggcataaaaatagataaccttttgatgaggggcttttaatcctacaggatttttgattgtttgaattattagaaagcgggtcatttatgaggtaattttctatattaaggaatgtctccactttatatattttttctattatcttctgtatccgggataacataaaatctattcgcccgctccctctttgggagggagtgggttggggatgagagggaataaaatatgcctactgtatatacttgctgcctttggatattataggaataacccctttttctttcaggagttgggcatccctatcactgtttgtcttgagccacctttcatatattctcaataaatcgctgtttgtgttgatggatgccttatcgctgacctctgcaattacatctatgaattctttaaatctctctgatagctcactgaagagctcactgaaaagctccccatttccgtatctcttggtaatatatgccaggttgctgtaggctctccctccgataactatataataatcaatatcaataagttttttcttaaggctgtcggagaaaaagcccgatacaaacagtgaaaaatctccaacctgcttaaatttccttatcctctcattgtattctgaatttatggcactttctaaaagcattataagaggctcatcagatgcctcttcagggaatgatttatcaatttcaacatactcagagagaagattcactaaatagaatgccactgtctcatcagtgtctatatcctgatggtctatagccgtatccaccagttccttgaagaattcagcagtgtttttatgtgttgttattttggctgccatatattttctctaatttaaaattatgccatactttttaagccattcagtttcgtcaaatttatccgaaatatattcttcaaaggcagcctcattttttgtaagtattctgccgtcaatgtaatctccttttggttttgattcatttggattatcttctaatgatttctccgctgtatttatgaagtcgtttaccttgattatcaaggcaagcattgcagatggttctatcatattcctttttttaaggtcaaagagaatgcccagcacatctttagattttaggagcgcctttgtaattgcccttgagagcccatcaagctctttgttgtctttttcattatctctcattatatcctcctgattatttatcggtattatttttaataatataattaagcaaaaaatataccatgattatcacttaattttaattcattgaaaaagaatgagatagctgatatattgaaataaataaggctggaaattatgtcctgattgtgtcaaatttatccagatttaagaaaaaatgttatgatattcgccaatgaaaaaatacggtgagaaagcaattgttagtgcaaaattagaagcgtgggataatccctatccggatagggattataagattgaaataagtttcccggagtttacatgcctctgccccagttcaggctatcctgattttgctacattcgccataaattacatccccgataagtgtataatagaactcaaatcactgaaactatatctaaacagttttagaaatcagtatatctcacatgaggcggtaacaaataaaatctatgatgctttaaataagactttgaaaccgcgttttatagaggtagtgggggattttaatgaaagggggaatgtaaagacagttataagagttacatcaaaacagtagtctaatagtctaaaagcctaagagtctaagagttgtttccttttagactcttagactgttagactgatttatttggttgactcctcaaggtctaacatcattgtattgccgacatatttcttactgattaccctttttatcctttgtagtttctttgtgacctcttttattctcattgcactctgaattgcagtattaagcatctcctttatatcttcattatttgtattcatcagggctaattcaatactgctgacaatgcctgtcaggggattatttatctcatggtttaaagttaccgctaactgagaaagtagagattctttatccttagaaagtatagtaagcgaattaatagaatttgatgttaataaatttaattcacttgctaattgttttgacataatgttgaccaccctctaaaaaatttactaatttatgttgcacttactatgccataatctattattatgctaacatattgatattataagtgttttgacttttgaatacccaaaatctctattgtaaatatgtcaaagttatgacttaatgggaaaaatattccgattaaatctatcatgccttaatatctttatcggatttatctaagtttttataaagtctttttttaggcgggctattctatatagagattcctcaatcctctcttcttttatctcaccactctctaatgtccttaatatagaattgaacatctctatctgtttattatggctatggcagattaagagtatatcaacccctgctttaacagactgaattgcagaaattttatcgctgtaattatttgagattgccttcatttccaaatcatctgtaattactacatcattaaacccaagtttttttcttaaaatctcatttattattttctctgacatagtagcaggataatcaggagctaaagcagggtaaagaacatgggctgtcataattgcccttaagcccattttaaatgtattaataaagggtttaagctctatctcctctaatctttctattttgtgatttacgataggaagttcaaggtgggaatcagagaaagtatctccatgtccggggaaatgtttacctacaggaattatatttttttcactaaatgcctttatgacatgcccaccgagtctggatacaacatcagggtcggaactgaaagacctgtcgccaatgatagggtttttgggatttgtatttacatcaagtacaggtgacatattcatatttacacctatttctataagctcatctgccattaaaagggcatttgaccttactgcatcttctgaacctgctcttcccaactcgccataagaaggatactgtctgaaaggaggtttgagcctgaacactcttccaccttcctgatcaattgcgattaatagagggattttatggcttttaattgataattcctgaagggaattgcataaatctttaacctgtgacggagactctatatttcttgaaaataggattacccccccgaccccataatcagttattattccttttaactcatctgacatagtagtcccatgaaatcccaccataaacatctgcccgattttttcttttaaagatattattgacatggtatcaatctaaaataacaaggagtgattttgcaatcataatcttacaggatttggtattgacaagtaaatagatttacctataatgaagatgaaattattgaaccttaataaaacctgacaatgcaaggacaaaaacttggtatagatttaggcggtaagcatgtcggtcttgctgttgtaagaacaccgataaacgaggtggcacattactgcactattgaactcagagaagacattaaggataagatggatgagaggaggtctcttcggagggcgaggagaaacaggctctggcatagggaagcgaggtttgacaataggcaattaagggtgaaatgcaaatatattgataaagatacaggcgaaatctgcggagctaatactccaaagaaatccaatgtaaaacatcttctacttgagaatatactcgtcaatcttaaaatagctgatgaatctaaagaggaaatcagaagaagagggctggacagagacacaaacaaaagtgaattacagacaatccttgagaaattttcaataaataccttcctgaaaaaacagattaaagacatcattcttgaaaagggggaagggagggctgtcttttgcagagagcatatcccctttcattatgaacaggttgcaacagaggctgagagtttctggctgtcaaattcaataagggctaaacaggaccagatactctcccgccttaaaagaatagcaaaggattttaagatagatgaggtggttattgaaagggcgaactttgatttgcaaaagctccagagacctgatgagatagaagcacctgaagattacatgaagggtcctaacttcgggcacagaaacaggtttgaggcattgaagcaggaatatggcaaccgatgctgtttctgcggaaagaagggtggagatgaagtaaagctgaagatagggcatctctatccgaaggctaaagatgagataaacaggtgggaaaaccttataactatatgtgaaaaatgtaatgcgaagcagggtaaaaggacaccagaggaggcagggatggaatttgtaattgtaaaggagaaggtttttaatcctgcagcaggaagggtaatacccataaaaagagaactcaagccgaagcccataaatgaatcaaaggttaataaatatatgacccatactgatattggcataaggaggctcaaaagagaaatccagaatatttttggaagcatacctataagagaaacatacggctatatcacatcgtattttagaaataaatgggagcttgaaaaagaacattataatgatgctgtagtcatagcctctgacaaagaagatttgaatataaaacctgtatttaaagatgcagtccctcagacaattaaatcatctatcaagggcgggaaactctttgatacaaatcccctccagtttagtgatggaaagttttaccagaacataacccttataggcagaaaggcagggatgcgttcatcaaaacataaaaggggtcagaggaatatcaggaactatggctcaatttatatggatgagattgaacttataacctcagaatggaagaaaaaggttctctgcgaattaagagataaacttggttatgtaaaaggagataagaataagtcttttaagcctgaggaactgatgaatgcaaatctgcctttcaggactgtaactattgacaaaaggggtgtaggagaatcttcaacccgcttaatcaataacaatgtattccgtgcctcagctgaagtaaatacgcatataatggtctattcaaataatgacggtagaatgaaggcatttgcagtaaaaaatcctaagatatttaaagatgccggactccctcatgattttcaaaaaaagatattcattgtaaaaaagggggatattgttacatggaaaaaaagtgaagatggaattgccgtaacaggcagggtgaccaaatgtttgacaaaaaatggggtaattgatataaaggacatgaataataaaatacactcagggaaaaaccctgtgtatattgaaaagatagtatctcctgaaaggggtgctatttttgagagaaaatctctttctgctctttgaaaattagatattaaagattgaaaacagcctgagtgttgaaacagacactaagttgttgggaacaggtaaagaactacggcggggtatcttgaatggttaccagctccgccctcttgtagtttttgagtaggaagactcgcccctttggggaaggaaaatggtcggtaagccactgataaggccatctacaactcatagacatgccctgtccgacaaccttggcaagggaaaccattaaattatctaatatcatattttaatctaaatacagtggcattaaaaccagaattagtaattgagaagatttcaatctaacacagtggcattaaaactacgacctatcctaattattgatacagcgaaacaatatttcaatctaacacagtggcattaaaacccataaaaagggctatcttttataatgggttatcatttgaagggggagttttaccctatcaacctataataatgacttcctcctatgcaatgggaatgttataattataaaaatatcaggagattaatatgacaaacacattggaaatagacagagatatatataatatacttattaattcctttggtgaaaatacgctgagggaaaaaatagatgatattctcctgtccgcgatggatagcttgctggaaaaatacactcgtaacatattggtatttgaagaaaagtatggggtctcttttaaagaatttgaaaaaatgtgggatgaagggaaaattgataataaacataaccacgaaatagaaggggattttattgattgggaaatgttagagatggaaaaaaaagagttgttatcagcactgtccagactcaaaggctttaaaaaatgaacaaccccaatgttgatgaattcctatcatcactaaagacctttctaaagaactattttacacaatataaaattgatttcttgataaaaacaccgaaatcccttaaagccaatattcatcttaatgagaaattttttattgcagttcgatataatgccagaaatgggagaatggactttgctttaatacaggataacaaaagaatttttggatatgataatttaaaggaatggcactatcacccttataaaaacccatcagagcatatctcatgcgataaaccatctacagataaaatcttatatgaaattaaaaaagtttttgaagatgctaaatgaggcatgaaaaaacgaaggagaaacctcatagaatgaaaaaaataataattgcaattacaggtgcgagtggtgctgtatatgcaaaatacctttttgatttcctttgcaaaaaaggtattgacctgcatattatcatctcagaaaatgcaaaaggaatattaaaggatgagacagggataggcgagaattattttaaaaagaagaaagtatcaatatatgaaaattcaaatctaaatgtccggatagcaagcggctcttttaaatttgatggtatggtcgtcatccctgcaagtatggggactcttgggagaattgcgaatggttattccaataatctaataagcagggttgctgatgttgcattaaaagagagaaggaagctgataatagtcccacgtgagacccccttaaatgatattcatataaaaaatatgctcaccttaagccgtgccggtgcagtaatactccctgcatcacctgccttctatcataagccgaaaggtattgacgatatagcaaaatttatcacagcaagaattctcaatcagcttgatatagataatgacctcatccctccatatgcaagagagggttaagataatactattttacctttgcacccaccttgacatccccatcaaatccaataagaaccaacctcccgtctccacctgctgccaataccatcccctgcgattccgtgcccatcagttttgcagacttaaggtttgtcaccagaacaattttttttccgattaattcttcaggtgtataactttcagcaatcccagcaacaacttgtctttcctctgtccctatatctactttgagttttaggagtttttttgatttctcaatcttctctgcctgttttatctcaccaactctcaaatcaacctttgcaaattcatcaatacttattaactgcctctcctcaactgcccctgccgattctgttactgttgctgttactttatcaccaatttccattttctcctccaccctcggaaaaagctgtctccctattttaatttcaatgcctgatttaattccaccccattttattgattctttaaaatcataattttctattctatccttaatccccaattgattccatatttcctgccctgtctctggcataaatggatatatatagacagcaataatacgcagactttcagctaaagtatataaggtatttgatagtgtcccctcatccttttcactccacggtgcagacttttgagcatattcattcatatctccgatgatcttccaaatgtaagaaagtgcatgaggaaattcgagtttatacataaaactgtcaaaactgtttgcagcataactctcaaaaccttttagagcaggatcgtatttaaaataaccctgaatattctgctccatacccctatttttagcatcaatttcaggtggaatcttaccctccctatatttttttatcatattgagagtcctgcttaatagattgcccaagtcatttgcaaggtcactgtttatcctcccaatcaatgccctctgggaaaaatcaccgtcaagtccaaagggaacttctctcatcaaaaaatacctgaacgcatctaccccatatttatctatcaattcatgcggatttacaaaattccctctggactttgacatcttctcaccgttcacagtccaccagccgtgtgcaaatatattttccgggagtggcaagtccaatgccttgagcattgttgaccagtaaactgaatgggtggtgagtatatctttccccagaaggtgttggtctgcgggccaccactctttgtcattgggggcaagatattttgtagcagaatagtaattaacgagtgcatcaaaccagacataggtaacatagttctcattaaagggcagtggaataccccatgaaagcctctgctttggtcttgagatacagaggtctcccagtatgttattttttagaaaaccaagaacctcatttttacgggcttcaggaagtatataattagaatttttttcaatatattcttttaaatcttcttgatactttgacatcagaaaaaagtaattttcttcttctatgtgttccacaggacggccgcagtcggggcagttgccaccttttatttccttctctgtccagaacctctcatcagggatacaataccatcccaaataactccttttttctatcttcctttcatcaaataacttctgcaaaatatcctgcacaatcttaatatgcccttcatcagttgtgcgtataaaggcattgtttgagatgttgagtcttttccagagatttttaaaattctctaccattaaatccgcatgttcttttggtttaagacccctatctctggctgccttatctaccttctgtccatgctcatctgtccctgtcagaaaaaacacctgatagtcgcagagccttttatatcgtgccataacatccgccgctacagtggtataggcatgccctatgtgtggaatatcatttacatagtagataggtgtggttatatagaactttttcatcgtaaaattataaactccaaatcccaaattacaaataatatccaatatccaaaattctaaataatttggtcattgtgatttggttattatttgattattgatatttgggtattggaatctgttttatcccgtcaactgtaatctcttaattccctttgcttgtcctgaattttcatctatatcaattacaacagcattaaattgaccttcaccgcccgccatctcaaacttctttggcatctttgtaagaaacttctctaatgcaagttcctttctaattcctatgaccgagttggatggccctgtcattcccacatcggtaatataagcagtaccgttaggcaatatcttttcatctgcagtctggacatgtgtatgtgtcccgattacagcacttaccctcccgtccagataccagcccattgcaattttttctgatgtcgcctcggcatgcatatcaactattgtaacctttatc

SEQ ID NO: 83 - DNA, 11155 bp, synthetic construct
  misc_feature 1..11155: note = Synthetic
  misc_feature 1..5657: note = n is a, c, g, or t
  source 1..11155: mol_type = other DNA
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgtgggcgacctgggcgtgctggcgggcgcctggggctgggccttggccaacggcccgggcctgggcatcccggcacccgagccggccagcctggtcctgctgggcctgggcgctctggcgctgatccgccggcgccgctgacgggtgtacagccgccgccatgacgagcaaaggaaaccggcgcccccaggcgccggtttcctttgcgtctgctttggaccaactctacgcgatagcccggctgggccggggccgcgacggagccgtcgggatcaaagttccttgttgatcagcgtataactgtcatgccagtcgttgtttgggccgccttgctcccagatcttcagcgcggcgccccagttgactagcaggaggtccatgatgacgctgctggtgcgcggctcgacgtgggcgtcgttgaacatcacgttgaaggtgggcttatagtacccgccgcgggccgtgtgcaccgagatggcccagggcaagaccgactggtcgatcatcaacgccttgtcgttctccatgctcgagaacgtccggaaagcgatgtcccactgcgtgccgtacaacttgccccaggcgttgaaccagtagcccatgcggaccatggagctccagttgtcccacgtgccccatttcatcagcacgttgggctgcaccctgcgattgtagatgtactcgtcatagacgaaccagttgttcgtctgcgccgggcaatagaagaatcgcgggctgtcgatgaaccccgcatcgtagatgatccccacgccgcggaaccgctgcttgagggtgacggggtccaggtcgttgaccttggaggcccacatggtgttctcgacgcaagggaacatgccgttgacgtagggcgccccgctcttgaacgccatccggtacggcgggtacttgtccgagctcacctcgctgtacatgagcatgcccttgccggtggaattctcgttggagctgcacactatctgcttggcgatgtccttggccaggttcaggctgggggccaggatcgagatcagcagcgagatgatcgcgatcacaaccagcaactcgacgagggtaaacgctttacgcaccatggtcagcctcctacgcgctcaaaacccaggcccgggcacaagcggtcgcccgtgctttaccggacccgccagtcacaaccttattgtacaaccttttgcagtctcccgcaagccaccccggccgggctctggggccaggttccggtcaggatgcgcccgttatcggcccggttattgttcaagccccaggcttctccagggccgcagggccagaaggcgcttgtcctctctattatcgtaacgaagagccaaaaacctttcaagcccccgtatcgacaattcctgcaacggatgggtgattcatagggggtggtgtcctcaatcccgacgccggattggccgccgacgttgcggtcacaggcggctccgccgaaggcaggccaacgcagccaaactgtcctccctacggcgccaggatgccggcgccggccacgggagtcatgatcctcgccccaaaatccagccctcgcggctcatagaagtccttccgcaggtggtgcataagacgatcgaccgcctcgcggcgcaccaggaccatcatgcttccgcccaggcccgcccccgccagttgcgccccgatcacgccctccacctggctcgacaggtccaccagggcgtccactgcctccgtgctgcacgcgtaccggccgcactgctgcgccaggtccgcctgctgggccgccagttggcccagaaccttctcatccagccgggtccgccacgcgcgaacctgcccgccgcggcggaggctgacgcggtccccgtcgtggctggcgtgcatgtaccgccccagccccgccaactcgccccgcgacagcagccgcccgtattgctgcgcccggacgatctccgacagcccaaacatcgccaccccgcgtaggtcgtagccgccgcgatggcgatgcgtgctgaagatccgctccagcgccgcctgctggtcagggaacatcgtccgcagttgtggccgcgtggcccgctccggcagtcgcgacagcgcccggtacaactcatcgacgcccaggttcagccgatccggcgtcaggtcgcgcaggtgctcggccgacgccgcggggggccagtgcttccgcaggtgcatctgggccagctcatagcaggccacccgctggttgaaggcgtcgcgggcgctgtcgctcttgagggcccgctggccgctgtaggccaccaccaggctcaggtccgacggaaagctcacctgcccctgtagcccgaaggggaaaaagccgattcgcgccacgcgccccgcctgggcgcggcagatggcggcgtggtcggcgctgcccccgcgcgagccgacgaaccattctccttccccgcacaggtcgatgaagtcggtggagctcacgtgcaggccgttgagccgcaccgcggcctgcgcaaaggccaccaccagcgccgaactgcttgacaggcccgaacccatcggcacgtcgcccgacacgaagcagtccatcccccgcaggcgggcctgggggcactcgtgctgaagccgcagcagcggcgcgcgggcgtagtggctccagtcgcccggggccgcctggagcaccgcctgtgccgcctgcgactggatcacgtccatccagtccgaccagctatacccgcgcaagagctgcgcgagggtaaactgccgcggagggtggtcctccctcgcgttgcgcaggcgcaccaggtcgtcctcgcgcggcgcggccgccaggagcgcctcgcaactgatcgccatcacgttgaccatgcccccgcggtggtcgatgtgccggcccatcaggttgatccgcccgggcgcgcggaccaccagcaccggccggtcgggcccgtaatgccgcgcgaaacccttgagcaccgagacgaacgctcgctggcgccgtcgttgcagggcggcgtcgtccccgtaaacctcgcgcaggaacgaccgccaggcccgcggctgggcctcgatcagctccagccagcggcgagccggcttgagcagccgggcagccggcttggccaggaccggggaaacccgtgggggcttctgccgcgccagcagcgcctgctccaccgccaccagctccgccggcgtgttgaaggccatcaggtcggccggatcctccaccggcatcgtctgaacggggtgcgactgggcgatcagccccatcgcgtcggtcaggtatagctcgccctggctgttgtcgcccgagagccggcgcagggcctcccgcaggcggtccaggcgcacgcagtacagggacgcgttgacgctcggagcctcctgctccagccgcgcggcgtccagcaggcggttgcccaggcggatccggcggcccgtgcggaggtgctcgtcgatgtcgctcttctcgacaatgcccgcaaaccgccccaggcggtcggccaccacgcgcccggcggtggagtccgccgcgcggggcaggacggtgaccacggcgtcggcccggctgcggcggtactcctccagaagctgcatgatgatgtgcggctggatgatcttgtcgcccatgaccaccacggtcgggccggtgtagccctgggcggccagggcctccgccgccacgcagaccgcgtgtccggtgccgcgggggatgggttgaaagacgaacatcgtctccgggtgctcggaggcgacggtgtccatcacctgctcggccatctgccccacgaccacgacgaagcgtttcagccccgcggcggcgtaggcgtccatggcccgcaggatggccggccgtccggcgatggggaaacacgccttgtgccgcccggccgaggccatgcgcttgccccgcccccccgccaggatgatgcaagcgaactcttcactgttgaccatgacggttccgtcgcggacgaccgccgctacccgcccgacgcgggcagcctccgcaacggatgatacccgtctggacccaaggagccaatccttgcctcgtcaatgacagccggacacgcccagcgcggcgctgggggcgcgaggcagccaacaagcatggcagactggcttacgcggcgcctcagccaagtcgggcaggcaaccttgcccgcgcaaagaggtcgtgcaacccgggctattgcccgacacttcatgctgggcacggctcctacacggggcacaggtggaagtgccaggttatcgttggaatggcaccctcgaaaatgttgcaagaatcggcggcccaccttcttccctcgaacccagagttgggttagactgtagtctcgcaacgccttgggcaactcatggaaaacgtgctggggatagatctgggcgggaagttcgtcgggctggcagtcgtcaggcagccggataatcacgtcctatggtgcggtaccctgcacctgtctgacaagatcaaggacctctacgacctccgccgtgtcctccgcagggccagacgctccagggtccgctatcgcaagccaaaggtgccccagcgtggaggcggcgcctcaggcagcggggcggacggagctacctatttctaccgtcgggccaaggggctcaaccagtccctacggaccaagtgcaagcacgtagacccacagaccggggaagtctgcggcaagaacaccccccgtgccgccaatgtccggcatttgctgctggaggacatcctgggcttcgagcctttcaaggccgtccccgaatcctaccgccaggccctgctggaagtgttggcggcaacacaaggcacgccccgaaagcagcagcggcttaagaacatccttgcccaggtggacgtggacagctatctcaagaagcaggtgatcgacatcatctgcaacgacctcgatggccgctgcgagttctgccgggaccacctgctggcccaccaccagcagaccgccgtcccgaggcaggcgtactggctgcccccatcgatcaagctcaaacaggacttcctgctcaagcatgtccgccagcttgcccgccgcttcgacatcgacaggatcgtcatcgagcgagccaggttcgacctccagaagattgccgccggggttattgacgatccaacggagtaccagcagggcttccgcttcgagttccgcaacacccgcgccgcactcctacaggagtacgacgggcggtgctgctactgcggcaaggaagttttcggtcagaagtggcacgttgaccacgtgcagccccgccgacaggagcaagtcgatcgctgggacaacctggctatcgcttgcgagaagtgtaaccatctcaagggcgggcgcgatccagaagaagccgggatgtcctttgccgtggtgactgtcaaggcagccggcaggcccatcaagcggtcattagcccccaggcccatcgagggcagccgcatccacaagtacatgacccagaccgatcagggcatccggatgctgaagagcgccctgggggagcttc

SEQ ID NO: 84 - DNA, 13678 bp, synthetic construct
  misc_feature 1..13678: note = Synthetic
  misc_feature 1..9999: note = n is a, c, g, or t
  source 1..13678: mol_type = other DNA
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaaactcatcgaactcgaactccgggacgacatcaaggacagaatggaagagcggagggcgctgcgcaggcatcgcaggcagcggaaaaggtaccgcaggcccatcgagcctgaccgccagggcggtgtcaggtccgcccccccctaccgcagagcctgcggtcagaaccgcgcatcgaccatgaaatgcatgttcgtcaatcccgtcaccggtgaaaaatgctccctcaatgctccacttaaaaagaacatccgccgcgaactcatggcaatcaccctgaagaattcggacattccaccgggtctgaaagacaatctcgtctcatgtttcgaccggaagcggaacccgcccctcagcacttctgatctcatggcccagctccggaaatggaacgccccctcgcagaccgtccgcatggttgaacaactcctgcacggcaacctgcacggccgctccgactactgccgcgcgcacctgcatgcctgcgccggagactggaccgccgagcggcactccatgcccctttcgaattccgtcctcgcaaaacactcctctctcgtcagccttcttaaaaaactgtcgaagtattacaacatcgacagagtccgcatcgaggattccaacttcgatcctgaattaatacgttccggccgcctgctggattccggggcaggagcggaccggccggatttcctcaagaaaaatactttcaaggccctgcagcacgagtatttaaaccgctgctgctactgcggcagggacggaagcagtacccgtctcgagatcgagcacgtgatcccgaaatccctcggcggttccgacacctgggagaatctcgttctggcctgcggcgattgcaactcccggaagggctggcggacccccgaaaccgccggtatggattttcacgtcctggaaggtgtgattgtcgccggcgtgccgcgccgggtttctctggaaccggtccctttcgagcgctcccggacccgcggattcatggataagaccgatcccggcaaacgaaccgtcaggaaacacctccggcaggtttttccgctggcggaattcgagttcgacttcggctacaggacttcatatctgagaaacaagtggaactgggaaaaatcgcgctgctgcgacgctgctgtgatcgcggccatggccggcggcgagataccaggcgctccccccaccattccactggaaaaatcagttttgaaatttaattccggcggcggaaaactgttcgatacatttcccgtttcaaaaaccggcgccggctacgtgcagggccgaaccctcataagccgcgacggcaggtttgccagattcacgtggggggaaattaaaagggtggcttcaccagggaaaaagcgcatccttgaaaaacttaaggagaaagccggtgtgggcgccgtatccgacgcagaccttatcccggacgaccttttagagaccctgcccttccgccgtgttaccctcaagagaaaggatgtcggcgcttccgccgtccgcgggatcaacggcaattatttcaaggcggagcaccccaactggggaacagccgtttatttggataaaaacgggaagaaaaatttcttcatgattaagaacgcaagggtatttggaaaaacacagcctcccgaagattttgccaggctccttttcatcatcaggaagggagaccgtgtgaagttcacttacaagaacaggcagcggattgaaaaagtttatgcgaacttctcgaacgggagccttaaactgcttacggccgatggcgagacaatcatgaaaagcgctaaatcctgcgtccccgccggtggacgggacatataaacccgtctcctcttcaattccccggcgccgccggatttaacatcctcattcctatcgattcgggtttgatgaaaatggaaagcccggcggtcccgcggttacctgccgagtctcccacggaggctgttatggtccccggtatcctggaagtcacggaaagaatatcttccagcacgaacttgaaattccgggaacaatccgcatttccatcgatggggaacggctccatccgggttggcgcacccgccaccgcgccccggatttccgatatcgtcctgtcccccgaatttatcacgtaggcagaatcgggacccgacctgaacatcttccttggcaaccggcccacctgtatttcctcactgctgttgtcggaaaggacgacgcgggtaaccgtgttgtccgaaaaattcgagagatagatatggcccgatgcaacgaattccatgtcctggggctgggtttgcttcagcgcaacatctctcagaatgccgccggttgcatcgaactcgaaaagatggaacctggaccccgaaaccgccacggcgaacacggacgcatcgccctggccgcgtctcgttcccaggaggaccggtgggaattccaggttaacggagaactcgtccagggaatcgtccgatgtctcgatgcgcgatattcgcgcatcggtcttgtagccgacatatatttttccgctccgcgggtgatattcgagtagagccggctggtccggaaggggtatcgaggaaatccactgacccgaagttccggaataaacgctcagcccgttgaagcccgcgtggctcaaatatatcctgcccgcctccccggccgtggcggcggccgccggcgccagccccagcgccaccggcgtaaccgtcagttccccttccattgccacgatgtatatctccggggccgccgggttccatacgactgcgtttgacgacagatcatcgcaggttatacgcagagaaccggcccccgccctgcgcacggccgcggtatccagcgcacggctgaaatccgtatcgtcttttccgtacctcgaaacaacggttatggaaaggggatcgtcccggctcgtttgagttgaaactgcgttcagggaatcatcttttccgaatagatcgcttatgtccacagatcgcccgttgaccgagaatgtcacgtccagggtcgacgcccgaacggcgctttgagtatccgaataagagagagaaatgtatcccggcagtgaggatattgtatactccgccccctgcgccggattagtgaaagctatcaccggcggcgttgaatccacaacttctccccctccgttccctcctcctccattccctccaccacctccaccacctcccccgcagccggaggccgcagccaggaagaatataattaaaatattcatcgcggcgctgtgaaaaagaaaagagactcgatatcccggcggagaaaacattccaggcacagtattatttgttaagttcaatatattcattccggaggaagaggtgcgtgctcggatttaagtgaaaggtcgatggaagcagacacgccgtaagaagttgcggtcacggtcgccgtgccttcggtctgaacggaggcggtgaatgtgactgaagctacacctccctgagtcaaggcgctggggggcaccgttcccattgaagccatgaagtttacttcggttccgtcgcgcacgggattcccttcgtagtccagcacccttgcggttaccaccgtgctgtccttcatatccgcgaccaggatgtttttgcctgccgtgagcgaaatcgattccaccgcgtttttcagtgtgaggttgacggatgaagacaca

SEQ ID NO: 85 - DNA, 14079 bp, synthetic construct
  misc_feature 1..14079: note = Synthetic
  misc_feature 1..9998: note = n is a, c, g, or t
  source 1..14079: mol_type = other DNA
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcttttgcagcaaacacatccccttgcatcataagcagctgacagtagaagctgaaagttcgtggctatccaacagcatcagggcaaaacaagaccaagtcatatcacatcttgagaagttagcgaaacatttttcaataagtgaagtgattctggaaagagcaaactttgaccttcagaagatacagggaatgattgagaatcctgatgattatatgcatgggttcaatttcggtcacagaaacaggtttgaagctttgaagcaggaatacggaaatcgttgctgcttctgtgggcaaacaggtggcgaaaaagtaaggcttcaaatcggacatgtttatccgaaagcaaaggaagaaattaaccgatgggaaaatctcattactatttgtgagaaatgcaacatcaaacaaggcggaagaacacctgacgaagcagggatgaagtttgcagtagtaaaagagaaagtcttcaatccagtacttggacaaataataactgcatcaagaacgctttcaccgaaaccactcagtgagtctaaaataaataaatacatgacacatacggatataggaataagaaaactaaagaagcaaattaattcaatgtttggagatatacctataaaagaaacctttggttatataacatcttattatcgaaatcactggggattggataaagagcattacaatgatgcgatagttgtcgcatctgaaaaaggtgatttaaacaagaagcctcaatccccatatataaagcccgttgttatcaatccgaagattaaaggcgagaaacttttcgacaccaatcctctacaacataagaatggcaagttctatcaacaaatatctttgataggcagaaaaaagagtgctcgttcttcaaatcataaagctggacagagaaaaataagggcatataatgcattacggattgaccagattgagttgattatgtctgcatggaaacggaaaatacttgatgagttaagagagaaactcggctatatgaagggagacaggaaaaaatacttcaagcccgatgacatcataaatgcaaatctgccattcagaactgtgaccatagaaaaactaggagttggcgagagtgcggtaagaaaaatcaagaataatgtttttcgtgtcgcttctgatgtcaatacccatataatggtttactccacgcctgactcaaaaatgaaagcgattcctatcaagaatacaagaatatttaaagatgttgacatgcatagagatttctccaagaaacttttcatagtaaaaaaaggagatgtagtctgctggaaaaacaaaggagtcgagattacaggtaaggtaatgaaatgcttgacaaagggtgcgagcattgatataaaggatatggattctgacaagacctacagcgctaagaaccctgtttgtattcagtcggttcgttcctctgaaggtaaattgctctttgaaaatagaaactcaagattgaaaaccgcctaagtgttgaaatagacactaagttgtcgaaagcaggtgaagacctacggcagggtatcttgaatggttaccagctctgccctcttggagtctttgagcaggaatactcgcccttcggggaaggaagatagtcgacagaaggccacttaattaaggctatttacaactcatagacacgtcctgtccgacaactttggttagggaaaccatttaatattttattgccctatttcaatctcacattagtggcatttaaagaggcacaaaggcatcccttatgatagtttccagttcatttcaatctcacattagtggcatttaaagatcagactctggattaatgtcgatctgaaaaaggaatttcaatctcacattagtggcatttaaagttttcagcttgtgcaaacttcttgcataaattatctcatttcaatctcacattagtggcatttaaagtttattaattttgttcattagaacaatccttcctgaatatttcaatctcacattagtggcatttaaagagttacccactctctacagcctgattcagcaataatcatttcaatctcacattagtggcatttaaaggcaaaacttctttttattttataaggtgttttgcgcctatttttagaatatcgtctgtcgatctccagtaacacaagaatcccttagggtcgacgacttattattggacgaacggaaacaaaatatgacggcattattccgatatactacctatcaatttgcatttgtaatcccaacttttttgattatatcacaggcgtgaagtacaggaagttatacgcgagtcttccacgtatttattttcatttattccaaaatgaccacctgagaagccccacattgcaaaaactcagaccaacccatatctaaatacctaccaaaacaatacaaacataaccaggacaccatgataatttcaaagcactatacacaggttaactatcaaatattttcacacgtgacagatggacgcatgaaaataacaaaacgcctacttacattttataaatgaaacatttaaaaaatgcaggacgtttttttgacagttaaaaatcaaaaataagtgctttgaaaatatcatgtttattatttttaatattatttaaaaggctctccattgatcaggaagtaattatttcttactgtagtaaaaatgtagcagaatgtatccgaattttacataatataccgaaaatactgggaagaatataataggaaattattatttaaaatcacttagttaagtcataacccaagccagaagccactttgtttaaaatgttattagaaaaatttgaagtccaggagggacaccagaaccctatgcactccctttaaaatttagtatagtagagggttaataagggtgtcaacaggcaaacaagactgttattatcatctaatgagtctttgataatttaattttttgtttgaaagaagaggggcgaaatgaagattgaacattattcttttggcaggattactattgatggaaaaacctatacctctgatgtaattatctatcccgataagataaatgcttcatggtggaggaaggcagggcataatctggaagttgttgacctcattgatgttattagtgcaaaacccgaagttctcgtaatagggactggtgcaacaggattgatgaaagttccaaatgagacaatatcgcatcttgaatcaaagggcatcgaggttcacgtgacacggacagaaaaggcggttgaactattcaataagcttcaaaaggataagaaggtaatcgcggcattgcatctgacctgttaagcgctctttctttaatctcttgagtgctccgataattgccggtccttccctgaatgataaaaagcctggtatatatggaaatagaacctctaaaactgcaaaggcctcttccacaagaattaattcaggatatttataaagacaagctactccgacaaccttatcttcaaagaatgctgcatcaacacctgcaataaatttcggattttttctaaagggaataatttttaccttatctctcagggtcatctggatggccttcgcctctacaatatttactggccagataaaagattccatagtaatatattacctgtcttactttttttaaaatagatctccagattttctatacagaattgcttaaaaaaacatccaattgaaaaaataggcaaaaattagtaatattagttttcaaccagttgcttggtaaatgagttgatttgccaggctataatgctgacttctgataaaaggtcatatgagtgaacttgagaaattaagaagagagatcgatgagatcgataatgagatccttaagcttttgaacaaaagggctaatgtcgtcattgaaattgcccatatcaaacgaaatgagaaggcaaaatattattctcctgagcgtgaacgggaaatcattgaacgtattaaagctcttaacaccggaccttttccaaatgataccctgaaagtcatttaccgggaaatcctttctgcttccctttccctcgaagaacctctaaaggttgcttatttagggccact

SEQ ID NO: 86 - DNA, 21919 bp, synthetic construct
  misc_feature 1..21919: note = Synthetic
  source 1..21919: mol_type = other DNA
gaatcatttcggccaccagcgccaacagcaccagcccgatcagataccaccaaagcttctgttggttctccacccgttcgcgggccgccttttcgccgaccaccggacgggccttgactgcacctttgacgctctcatccgcacgaggttgcacggaagaaactaattccttgatatcgtccccgctcaatggccgcaggtccggctcgcgggcatccaggttggccgcgaacctgacttgggtctggccacaggtcagctcgtaaacgcccggccgttcgggggtgaacgacactgttggaagaccatcgctgccggtttggatgccggggggggccttctggccgtcgggcgtctgtagctcgaccttgtcgaccttgtgtacgatctggtaagtgaccttatcgccgacgattacattccgctggccggccgagtgctccgcccacagccgcttggccagttggtggacgaatggcacgaacacgctcttgaggcacagattgttccactccagatccatcgccgaggggaatagaatcgatttgcccttgccgagccgaatttccagcagagccgggtggccggtgctgaaacgcgccagcaccgacgccgcctgcaaccgctccacttcataatactgcgcgaactccgccagggcaaggttgcccgtatgcggcccggcgaaggggacgaagatttcgtgtttcaggtcgacgacgctgatgacggcgggctgctcgccctgccccatcgccttccggcggagtttgcacggcgccaggtcggccagggcctcgttgaaccggtcgggctggcagttctccccgcacacaaagcaaatcccgccgccgcgctcgaggaactccttgaccgcttggtgtgccgtcgaggagatgccggcgacgttggtgaagaacaccgcgtcggtctcgtccagatgcttcgcttccaactgggcggggctgacctcgctgacggagaagaagccggaccggtccttgatcggcgcggccagggccacgctgaggaagaagccgtcgttgcgggcgaactgcctggccgggtcgccgttgaccaccagcacccgcacctgcggggtaacgtgaacgcagaagtaggcgacgttgtcttcggacatcgcgtccttggccgtcaccgagatgctgccggtcacgtcgccggggtccttgaaggtatagcggaaccgaacggggacagccgcgcgcggacgaaggttgacagaggtcctttcgacgaccttttgtccgattgtgaaggctacggccgcccgcgggatgagctggttggtggtgttgacgatcttggcggaaacgacctggggcgaccctccggccacgatgagccgcggcacctgcacgcgctcgatcaggacgttcggcaactctttctcggatacgttctttaccgacagcaccgttccgttggagagcctccaattgccgccgctgtcccaggcgctgcgctgaaagtcgctgatcagaaagatctggcgccgatccttggcccgatcggacaggtaccggtcggccgccgccagtaccagcgagaggtctgtgccccgccaggaaggctggattgcctgaatggctttccgcgcctcggccgggtccgagccgatctgggaaaggggctgcaactgccgggagaaggaggcgatgccgaccttggggccctggccgagatcgcccaacagttccagggcctgctgtttggcgctttccagccggccaccgacgcgcatcgagtaggagttgtccaccaggatcaacgccgcctggttttccaacatcgcgtcgccgctgaggcccttgggcctttcccggaagaacggacgggcaaaggccagcgccagggcggccagggccaccattctcagcaggatcagcagcagttccgtcagtcggcggcggcgcaccacccgctgcgacatggtccgcaggaagcgtaccgaagagaacaccacctgccgaatgcggcgacgctggaccaggtgaatgatgagcgggaccagcgccattcccgccccgaccagaaaccattggttgataacgtccagactgcccatcagtagcttcggctccgcttgaaaaggtactccgacagcgccagctccagcggcatggaggtgtcaaacaaggtgtaatccacctttagatcggcgcatccctggcggtaccgcccatagaattcgtccatttccgacaggtagtgcgggcggacggattgaggtgccgtgagcacgcgctcatcggtttccgggtcgacgaactcggtgatctgatcgaacgggaactccagctccgccgggtcgacgatgtggaagacgatcacgtcgttgcccaggaacttgaaatgttgcagcccgctgagcacgtcgtcgggctcgtccagcaggtcggagatcagcacgatcagcccgcgtttcttgaccccttcggccagatcgtggaagggcttgccgctgcgagtgctgccgccgggctggaggttttccagctccgccagcatccggtgcaggtgcgccgtccggctccgggccggaagcagcgtgcggatctccgtatcgaacagcaccagcccggtggcgtcgcgctgggtcatcatgaagtacgccagcgaggccgccatgtagcagccgtactggagcttggtcaaattcttggagccgtagcccatggaggcgcttttatccagcaggatgtggcagttgacgttggtctcttcctcgaactgcttgatgtaataccggtcggtcttgccgtagagcttccagtccaggtggcggatctcgtcgcccggcacgtacgcccggtactcggcgaactccacggaaaagccccggtacggactgcgatgcagcccgaggatgaatccctccaccacggtcttggccagaagctgcatgttgcggatccgcgagagggtctcgaaatccaggtacttgaacgaggtggtcgtctgctgatcaggcactcttgacgcctcactctcatgcggcacgggcctggcggcccgtgcggctgctttacaggccggagctgggcttgggcacagtttccagcagcctttggacaatctgctctgacttgacccgggccgcctccgcccggaagttggtgatgatccggtgccgcagcaccggcatcgccatcgcctggatgtcgccgacggacacgccgaaccgcccgtcaagcaccgcccgggccttgcccgccagcaccagatagtgggaagcccgcagcgaagccccccaggaaacgtattccttcacgaaatccggggccccggggtgagtcggcctggacacgctggccagccgcaccgcataccgcgccaccggatcggccaccggaatctcccgcacgatccgctggtacagcagcaagtcctttccgtgcatcacgcagtccagtttttcgggccgcttgctggtggtgctgttgaccacctcgatttcgtcggccttgggcaggtagtcaatgatgacgctgaacatgaagcgatcctgctggatcgtcggcagcgggtacgtgccctcatgctcgatcggattctgcgtggccagcacgaagaacggctcgtccagcttgtaggtggttccgccgaccgtcacctggtgctcctgcatggactccagcagggctgattgggtcttcggcggcgtgcggttgatctcgtccgccaggatgatgttcgcgaagaccggcccgcgcagaaacttcaactcccgcttggcggtgctccggtcctcctccagaatctcggtgccggtaatgtcggagggcatcagatccggagtgaactggattcgccggaaagtcaaatccagcgtatctcccatggtcttgatcagcagcgtcttggccaggcccggcacgcccgtgatcaggcagtgcccgccggcgaaaaacgagatcagcacctgctcgaccacctcgtcctggccgatgatgacccggcggacctgggagaggattctgtcccgcccctcccgcaactgctggaccatctcggccgcgcgcttttcgtcaatggcttgctcaagcgattccgatggctgaatcatcgtacacaatccttacctgccgtggccgaaaccctcaaggcccttagcccaccctcgcgggcacgggcatgttctcgaccagcctagtaatgatgtcctcgaccgtcaccttgtccacgtccgcgcggaagctcagcccgatgcggtgccgcagcaccggcgccagcaccgcctggatgtcctcgggcacgacggtcatccgcccggacagcgccgcccggctcttggcccccagggcgatgtactgcgaagcccgcagcccggccccccaggcgatgtactccttcacgaagtccggggcggtcgcatccgtcggccgggaagaggaaaccaagctcacggcgtactccaccagttccggcggcacctccaccgtcaggaccagctcctgatacgccagcaggtcctgtttgctcagcagccgcttgagttccacttggccccaactggtggacttcttgatgacggtcacttcgtcgtcttcactgagatagtccatcaggatcgacagcatgaaccggtcctgctgggcctcgggcagcgggtaggtcccctcctgctcgaaggggatctgcgtcgccagcacgaaaaacggctcttccagcgggtacgtgcgcccgccgagggtgacctgcttttcctgcatggactccagcagcgccgcctgggtcttcggcggcgtgcggttgatctcgtcggccatcacgatgttggcgaagacgggcccctggacgaagcgcagctcccgccgaccggtcgagatgtcctcttccaggatctccgtcccggtaatgtccgaaggcatcaggtccggcgtgaactggatccgcttgaacgtcaggtccatgatcttggccagggaggaaatcagcaacgtcttggccacccccggcacccccgtgatcatgcagtggcctccggcgaaaaagcccgtcagcacctgctccatcgcctcgtcttgaccgacgatcacctgtttgagttgccccaccacctgcgcagtgacttccttgagcttcccggcggaaacatccaattcggccattcacttgcctccgtcacaataaagtacagtcattcttaccggtcgagaccctcaggtcgcgcgatcgcgacgcgctcccgggattcgcggcctcaaaccgggacagggctgcgcaatctctctgcgcactgcctctactcatcgccagcccatccctgggcgagacaataaacccttccaggctggcgccgtatcggccggattcatattttcccccaagtctctgaaaacgcaagatctgcgcccgcaattcaagctggcccatttcccagccgatgaaagcccaggacgtcgtccctgcgaatcgcaacccggaacgatcccgcgtctcggccgttggggccgtgaagtctgacccgggtagttcaaagttgagggcatgaaaacacggaaaccggctatgtcgcttaaagtcctcatcgtcgacccggactggcacttcctggcccaggcgagaaacgcactggaagcccgcggagacatcacagtccacgaggcccgacccgaccaggccgtccgccgagccgaacactggtgtccggacctggtgatcatcaacgccgagctgcgcgactgctgcgacggcgacctgctggagcggctcggccgactgagcccccggccggcgatcctcctgacggccggcgtggaccagttcgccaaggcctggcgggcctggcagcgcggcggcgatgagctgctgctcaagccgctgatgcaccccggcgaattgcacgtcgcagttctccacgcgcgggagaacatgctcgtcccgcaccgcctgctcatacccgctcagccggtggccgtgtcggcataacccgcccgtgccgcgctcaccacgaggcgccccggccgatggcctttgctctccacattccacggcaaggttgccttacccatgactcacgccccggcgaccggctggcggcggtaatcctcgcggaggaccatctcatccagcaggcgcttctccagcccggcgcgctcggcggcgaaggccgggtcgtcgtagaggttccgggcctcgggcagctcggccgccatgtcatatagctccccgtactccttgccggcgtagtaggtcagcttccggtcgggcgtgacgatcgtacgcaggttctcgccggcgggcgtgcggtactccacgaaggccgcgtcgcgcctgcccgggccgccgcggacgagatcgccctgggcgatgccgtccatcgccggcgggacttccacgcccagcagctccaggatcgtcgccgcgacgtcggccgagctgaagagcccctccgcccgcgccgcccgcgccccgcccggaacccgccacagcatgggcacgttgatcagcccctccagcagccacgggcccttgtgcgtcagacccatgtcgcccatgaggtcgccgtggtcggaggtgaagatgacgacggtgctgtcggccaggtgcgtctcgaccagcacgtccagcatgcgcccgacgttctcgtccaccagcgtgaccatgccgtaggtccgggcgatcatgtcgcggatctgatcctcgcgccatccccgctcgcggaactgcggcggcttgtcggccagcgagtccggtgcgagcctgggcatgacgacctgtccggggtcgtacatcttgtcgtagggccgtggcgggcagaaggggtgatgcgggtcgggaaagctcacccacagcaggaacggccggccgtcgtcggcccgctggcggaggtagtcgccgccgatcaggcccagccagttggagctgtgcgcctcggccggatacagcggcgtgaagcactcgggggcgccggtgggcgactgctcccagtcgaactggcgggccagggcctcgggataattcttcttgacccactcgtgcaggtgggcgcggttgaggttcgcgtacccgtggccgacgctgatctgcacgtactggaagccgtagtagggcccgcaccaggacgggtcgttgacgccctgctcccaggccggcccgcactcgatccccagcgcccggccgtcgaagcggttggcggtgatgcggaagtgcggcttgccgaagaaggccgtctgatagccgcgctcgttcaccgcgtcggcgatcgtccgctcgcagtccggcaggtccacgccgttgcaccagcagccgtggttccgcggcagccgcccggtggcgatggtcgcgcggttgggcatgcacacgggattactcacgtacgcccggtccaggcacaccccgcccgcggccagtcggtccaagctcggcgtgcggatgaccgggttgccgccgcagcccatgtggtcgcgccgcatctgatcggtcgtgatcaacagcacgttcaacggcttgcccattgctcgcgtcctttccacgcaaagcgcctccgccggccggggccgctgccgccaagtaagtcgaccccgtcggccgctgcaagcgcaaaacacccgcgactgcttcgcccgcccggcgacgacgggcaggattttccgagacgcagggaggcccggccggtattcttgtcgcgggcggaccggcgcccgggcgcacggccggcagccgcgaccaaacccggcgggagagcagaccatgaagaaagtaaggatgggcgtcgtgggcggcggcttcgggaagaagtttccgtggcacgagcaccccgactgcacggtcgcggccgtggccgagctcgacccgcagcgccgcaccgacctcatgcagacctaccagtgcgacaagtcgtatgagtcgctggagcggctcatccaagacggcggcgtcgacgccgtcgccctcttcacgcccgcgcccgaccacgtgcggcacgccgtcgcctgcctccgcgcgggcaagcacgtcatctccgccgtgccggcggccacgagcctggaggactgccaactcctgctggaggcggtccggcaaaccggtctgacctacatgatggccgagacgagctggtatcatcagtccgtcatctccgcacgcaagtggttcgcggaaggcaagttcggacaaatcttctacaccgaggccgagtaccaccaccccggcctggagccgctgttcttcgacgccgccggcaaccgcacctggcggtacggctttccgccgatgcactacccgacccactgcaccgcctacctcaccggcgtgaccggcgagcgaatgacccgggtgagctgcaccggctggggcgacgactcgcccatcctcaaggacaacgcctacggcaaccccttctggaacgagacggccttcttcaccaccgaggcgggcaactccttccgcgtcggcatctactggcagggccccgtcggcggctgcgagcgcggccagtggttcggccagaacctcacgttctacgacccgagccccaacggcctgggctacatcctccgccggccgtcggagcaggtcgaggccgacgacgccggcttccagcggaagctgcccatgctcgagcagtacgaccagccgcagtggtggaagacggacatgctgcccgagccgctccgccacgccagcggccacgacggatcgcacacgttcctgacccacgagttcgtcgacgccctgctgcacgaccgccccccggccgtgggcgtccgcgaggccgtggccctgaccgcacccgggatcgtggcccaccaatcggctttgaagggcggggcacagttggagatccccagcttcgacgccaagtcctaggcttgccggcctgcccggcccgcctggcccgcccatggccggagttcaacagtccacaattcaacaagtgagccatcgggagcaaaacccaagggaacgcaaaggaacgcaacgattcgcaaagattcgcaaagattcgcaacgattcgcaacgtttcgcaacgtttcgcaacgattcgcaacgattcgcaacgtttcgcaaagtttcgcaaaggggccgatgtccataactcttttcttgcaaatatgttgcgtatttcgcttcttctcattcgcgcgaattcgcgttgttcgtcgcattcgcgttctctatcttgcccactttgcccaaacggccggaaccaagctgtaccgttcgcaaccattgagtaccattgagtaccattgagtaccgttgggaaccattgagtaccattgagtaccattgggaaccgttcggaacggaggcaaaatccgcaagtccttgggctgcaaggccctgtggatttagacgtgcgataaccttgatttttcgttcacgcccgggctccgtcgttgccgttccgtggtgcctggtgcctggtgcctggtccctctctcttccccagcttacccattttgcccagacggccgtgtgccgcattctgtcgttgccgttgccgttccctagtcccgagtcccaagtccccagtccctttgccgtttctggtccctattccctggtccctagtccctgtcttttgcctactttgcccagacggccggattgggtttgtttcgcagttttgggtctttcccgggctcctggctaccggctactgactactgcttccggcgttgccgttcctgttccctgttgcccgttgcctggtgcctggtgcctggtgcctctctcatgcacttttcaaagagcgtcggcgcgcacgtgtagcgcgccctccgtactctcccggcgcgttcacgtatgcgcgcgcaaacgctttcgcatggggagggcgaagagcgtaaatcccggccggggcggcagaagaaaatctcggagaaatcggattcgcccggccggcgcgttcacattcccgcgcgcaaatgctttcccatgcaagaaagaggtgcaaagaaggaaagatttccgcttgctgcatatcgtcgcattcagtaggctttgtccgatcggggtacccgatgccgaacgtgctggggatagatttgggcggcaaagccgtggggctcgccgtggtggagcagccggacaaccgcgttgcatggtgcgggaccgtccacctttccgacaggatcaaggatctgtacgaccagcgccggacgctgcgccggggccggcgctcacgcgtgcgttaccgcaagcccaaagttgccgaacggggtggcggctcggccggtcagactcagtggagcggattcaaataccgccgggccaaggggctcaaccagtcactccggaccaagtgcaagtacgtcgaccgggaaaccggcgaagtctgcgaacggaacacgccaaagaaggccaatgtccgccatctccttatccaggacatcctgagctttcagccgttcgccgaggtgccgccggatcacagacaggtcatccgcgatgtccttgcctcgcgcgaaggtgcaggaacccggcgtaagcggctccagaacatcctcagccggctcaacgtggacacttacctcaagaagcaggtcgacgacatctgcttcaacgatctccccggccgggccgaattctgccgcaaacacatcctcgctcaccatgagcagacggacataccggcacaggccgtttggctcccgccatcgatccgcctaaagcaggactttgtcctgaagcagattcgggttctgtcgcgccgattccgtatcgacaagatcgtcatcgagcgggcgaacttcgacctccagaagattgcggcgggagtgatcgatgatccggcggaatatcaggaaggtcaccgctacggcttccggaacacccgcgcggcgatgatgcaggagtacggggcgcggtgctgctattgcggcaagagcgtggtaggcaagaagtggcaccttgaccacatcgagcccaagaagaccggcgagatcaaccgctgggataatctggccatcgcctgcgaaaagtgcaatcagcggaagggcagcaggacacccacggaggcgggcatgtccttcgccgtcgtttccgaaaacatcgcgggcaggcggatcaggcgctcattggcgcccaagcccgtggagggcggccgcatccacaagtacatgacacagaccgatcaaggcatccgcatcctgaagcgcaacctgggggcaatcatcccccatgcacccatcgaagaaacgttcggctacgacaccgcggcctggcggggcgtgtggggcctggagaaaggcaaggagaagggggaacatcacaacgacgcaattgtcatcgcctcgctgcggtcaccggaggcggggccgatcatcgaagtggacccggaagtgagccgccaggctgtcggcgggaagcggatattcgaccagaaccccatccagcgcgcaggcgacggcaaccactatcagaggatcccggtcgtcgccgaggtcggcggcatcacgccgagacaactccgggccgtggtggacgaacagaagagggcgctcctggcacgcgagttcgagcggctcgagatcaaggggaatcggtcgcttccggatagggcccgccagcgcttgcccttcaagagcgtccgcctccgcaaaagagactgcacggacgagaacgttcgcacgatgaaaagcgggcaccgcttcaaggtctccaacgtcggcgggacgcgcgtcaacgaggcactggtcgtgtaccgcacacatgcggggaaggtagcgtgctatccgatgaagaaccggcgtgccttcgggcctacacttccgccagcggactttgaaaaggagcttaggcgtttcaggcccgccgacgcggtatacgaggctggggggaaggaactagggcggatcgtcgttctctggagcagcggtcgcgtgaagctggacagtggggtaaccagggcggcgaccaaatgcttgaaaggaggtggttgagcgaaggttgtccatcttgactacggtcgcagcgtgcatgggatgaataggcccagccagcgaaggagcagccatgagcgaattctggcctcgcgtgcatgggatgaattggctcaccatcctttcctgcgacattgcagacattttggcctcgcgtgcatgggatgaatagcttagccaggcgaaggcagacaacgagcggctgattttggcctcgcgtgcatgggatgaatttccccaagtgacctacgaccccgacattgagattttggcctcgcgtgcatgggatgaattcaggagaaatcagtacaaaggctcctgtggaaattttggcctcgcgtgcatgggatgaatactgagatgtcgcgtctgccagatcagaaaagcccagggtattgtggaagtcgcctcccgaagtatcgccgcggggccaacgaccgaggtttacccatgccctctaggtcaaaagcacgcctcagcgattccccgactgttcggggaagccagggaacccaacgaaaggcgggacctggccaggagctacgtttgcaggacagccaaagacctatgccgggatgtagtgcctcgtctacccagtcccggcctcttggagtctcggcccggaagattaacgccctcgcccttcggggcagggagagaaaggtcctcgtgaggggacatcgcgtcgggcgaccacgcgatcccgaccagaaacgtcgggaagacaagccgagacatgtgcgacctgcaaaccttggctggggatagacgagattcttttcgaggagtatgtgcggtgggtcgtgtcccgaccttttgtgtcgggatggcgacccaccgttcatttcgtgtacaatcagcagccatcatgacgaaacattttgctttcttgggtttggcgttcgcggccgtgttgtcctcggcgtgtccggggcaggaggttggcgggtcggggcgggcggttccggccgcgacggcgccggccgggatcaaggccgaggcgaagtggctcttcagcggcgatggcggcgagaagtggtcggcggcggtgccgagcgtgccgggggggaaggtcgccaccatcctcgcccgggcgagcttcaaggtgcccgacccctcggccgggagcttctgggagctgacgcacaagctgccgccgcggctggagatgaccttcgccctcaacggcagggaagttcccgtgccgctgaaggggatgtactacaaggcgatccctgcgatcccggccgggatgctccacgccgggcggaacgagctgacggccaaaatccgcatcgacaaccgcccgccgcgggacgaccgccagcgggtcatgccggccttcactttcgaccgcccggaagagccgcccgagctggcccgccagaaactccgaatccagaccggcccggtgctgggcgcgttcggggcggaccacttcaccgtcacctgccgcacgagcgtcccggccaaggtgaccctgcacgccttcgacggggccaccgagacgctgcggctggtctcgcgcgaggacgaggcgggcctgttccaccgcctcatcgtgaaggcgcccaaccgggcggagcaatacgtgctcacggccgtcagcgccgccgcccagggcacctacgccacggccaccatcacccgcccggtcttcccgacgaaggacttgcgcttcgtgatcatgggcgacagccgatcccgcaccgacgactgggcgaccgtggccgcggccgtgctggccgagaggccgcaattcgtggtcttcaccggcgacatgtgcggccgagggaccaacgactgggagtgggacgaacacttcttcgcccccgaggccgcccgcgagctgctggcgacggtcccgttctacgcggtcaagggcaaccacgaggagaacgcgccggtgtacacggagctgttctgtacgcccggcggcgacgggcggggggccaactggtcccagcagatcggcccggtgctgctgatcggcatcgacgggcagtggtcgccgcggtggaagccgatctacgacggcgtcgagaagactctggccgcctcgaaggcgaagttcatcttcttcatgtcgcactatccggcgtactcctcggccgggaacggcaagctcgacgagcggaccggccagcccaggcactgggcgtacctgaccggccggcgggtaatcgtgccgatgctggtgaggcacaaggccaccgccttcgtggtctcccacgagcaccactacgagcggtcggagcttccgggggggctggtgcagatcatctccggcggggccggggcgccgcggtcgggcaggtcgccggcggccgccaggcagaacccgtacgccaaggtgttcgccaagacgctgaactactgcctggtggaggtcgccggcgagaagtgcacgctgaaggccaagacgcccgacggcaaggtcatcgacacactcacctggcaggcgcgcaagctcgactgatcggccgcatcctcttgtttccggcgaaatatctgctcgggttcttccgctgaggcggcccgtcgcggcgcggggcaaggctcggctgctccccggtcgggcagcgacgggacggcggcgaggcggttgcaccgggcaagccaagccgcgaaaagcatttgaaacgagagtggaattgcggacaattctcgtgagaagcatcggaaatgccggcggagccgctgaggcagacgcgctttccggcggccaaccgcgagcatccggtccgatgcattgggcaacgcaatcatgctgaagcgattccttgaagttctcctgcgatcgccgcgactgttccgctcgaggggcggcttcaattacgggcttctgacggttgccgccgcgtgcttcctcatcacggtcctgctgccgccgccccggagcctggtgaggctggtctccgcggagcatccggtcgggtatcgcctccagccccagacgaaaacgatcacccagagcgtcaacgggatcctcaagaccgacctgagtccggagcaggtcgccggcaaagccaagaccatgaccgtggtgctgttcacggcggcgttcctgtgggcgacggaggcgattccgctgggggcgaccgatcttctggtgggggccttgctgtaccttttcgcgattctgccgtttgacgacattgccagggcgtacatgaaggatgcggtttttttcatcgccggcgtgttgaccatcgccgtgggggtgagcgcgacggggctggaccggcgcatcggcctgcttctgctggggagaatccggagcctcaaggccttctgctttgtcttcctgccggctctggccgtcgccgccagcttcttttccgagcacgccctgaccgcgatcctggttcccatcctggtcaggatgtacctgctcatttgcgagcactatcggatcaaggcggacaggtacctcgcggtgtttctgatcctgggggtgtgtttcgcgctgaaccagggcgggcccggctcgcccgcggccggcggacggaatgcgatcatggtcggctatttgcaggactccgggtgccccatttccttcgggcagtgggtggtgattgggatgccctacgtgattgtggtctcgctggcaatcggcgccttcatgtacttgacgctgaagaggaagctgcgcgtgccggaagtggacttcgccaggttcctccaggccgaggtcaagcgtctgggcaggatgtcgaggcagcaaattctgatggccgtcattctggcgtcggtcgtgttcctatggatcaccgccagccgccgcttcggcctgggcggcccctgcgtcttcggcgtcgtcctcatgctggtgttccggatatgcagttggaaggacattcagacgcgcgtgcgatttgacgtggtcggcctgtacgcggccgcgtgcgccatgggcgtggggctgaagatgaccggggcgtcgctgtggctggcacagagcatcgtcaacagcctgccggagtccatgcgccacggggaaatgctggtgattaccgtcagcgccttcaccggggcgctgacgaacttcatgagcgacggggctacagtggcggcgatcggcccggtggcgctttccatggcccagatcggcaacgtgaacctgtggaaggtcggcctggcctgcgccttttccgcctccttcgccaatgtcaccatcgtcggcacgccgaacaacgccattgcctacgtcggggccgtggtgcccgaaaccggagaaaggctgttgagactgcgcgacttcctcatctacggcctgccggtgacgctgcttgcgtggatcgttttctgggcctgggccctttttggatattggaagctgattccgtggctttccccgtgaccgccgatcgggcggccgcggcagccccgccgctgcccgcgggcagggcgggaagagcgagccgccaccgaagggaaaacgcatgagaagtctgagctacattctgaccgggcgtcccggaaatcgaaccgactgcatcgaccacgcccggacgcacccgcccaggaagatctccatcgagctgatgacgcaggaaatactctccgaggcgttcatcgcgaagacgctgttcgtgacgtacgtgtgggtcttcgagagtctcgtggtcacgtatgaggagacttacggccgctgcttccagcacgagacgcacgaacgccaatgcgtcagcatcgacaacgccaatcgacggctgaccaaggccctggagaacctccaagagcggacgggaatgtcgatcgagggccaagacgcgcggttcgaccgcgacctggcgtaccagaagtagaagacgcccgcgatgactcttggcgtttccgctgcgccgcgccggcgcgggcagcgcggccccggcggaggcggcgctgccgccaggggcctgacctatccccagtttgccgaaccaggctgggagccgacaagtgtgcacgtggcgagagccatggaatgagacatcgcccagacaattctggtgcgtgcgagcacgcaccctacgcccggccccagccccagcggggcgtcttttttagccccgtgcgacagcacgggggaatcgccggagcaagcagcgcagccccatcggggcgtcttgagagggtggggagctaagacgcccctacggggctccagggcgacgaagccctccacctcccagggctcgcgccctgggctaagaaaggcgcccctgccggggctacccatggaactggggataagtcagcccaggcgccgcttgcacaacccgccgcccgccggcatgatgatgtcccggctgcggcggtaatggaaaagagcgcggcttgctgggcgccgcgtgcgtcttgaagtggagaatgcgggcatgtccggtcgacggatcaggaactacatgggcggccgctgggccgacgccgacgccaccgactacctggcggtgcacaaccccagcaccggcgaggtgatcgccgagactcctctttccacgccgaccgaggcggatcgcgcggtcgccgcggccgcgggggccttccccgcctggtcggccacgcccgtcgccaaacgctgcgagccgctctaccggctcgtatcgctgctgcgcgacaacgccgagagcatcaacaggacactggtggaggagatgggcaagtcgctgccggacgcccgggccgagctgaagcgggcgatcgagaactgccaggtcgcctgcggcatgcccatcctccagcagggcgataagctcgccggggtctccgagggcatcgacggagaggtgctgcgcgtgccgctgggcgtgttcgccatgatcgccccgttcaacttcccggcgatggtgccgttctggttcctgccgtacgccatcgctaccggcaacaccttcgtgctgaagccgtccgagcgggtgccgtgcacgatggcgctgatcgccgagttcatcgaccgggcgggcctgccggcgggcgtgttcaacttggtcaacggcgacaaggccgtcgccaacgcgttgatggactctccggccgtcagcggcgtctccatggtcggctcgacggcggtctgccggctggtcgccgagaagtgcgcccggacgaacaagcgcttccaggcgatgggcagcgccaagaaccacctggtggtgatgcccgacgccaagatcgaccacgtggtccgcaacatgatcacttcctgcttcggctgcgccggccagcggtgcatggcggcctcggccatcgtctgcgtgggcgagcggacccaccggcaggtggtcgagcggttcgtcgccgccgcccgggaggtgcccgtgggcgacccgctggacgcggcccacgccgacagagacgtgctgatcggcccggtgatatcggccgccgccagggagcggattcacgcgctgatcgccgagggcctcgccgagggagccacgctggccctggacgggcgcggcctcgtcgtgcccgggcgggagaagggctacttcatcggcccgacggtgttcgtcgacgtccaagcgggcatgaaggttcaccgcaccgagatcttcggcccggtggtggtcatcctgaaggccggctcgctggacgaggccatcggcatcatcaacgatcaccagtacggcaacggggcgtccatctacacccagaacggccactacgcccgccggttcaagctggaggtggaggcgggcatgatcggcgtcaacgtgggcatccccgccccggccgcgtacctgccgttcggcgggatgaagtcgtcgctgttcgcggacatcaagacccaggccggatcggcggttcggttcttcaccgacgagcggatcgtcaccgagcgctactggccggaggaatagcgccactggcgcgggcggaccgtcgggcctcgacgattggggaattggagcttgagatttgtttggagtttgaggtttgcgttttaaggtttgtttgaagtttggaatttgcgatttgagatttgtttggagcttgaggtttgtgatttgagatttccagcctccctgaggctggtagaatactctccgtccgtgcccgcacggcgcggacacgcgcacactcacttggtcgaacaaggagatcagtcttgggcaagagtttgagcattacagtcgccggcgccggcaaggccggcccgtccatggccgcgcacctgatgtcgctgggctttgaggtaaagctgtacgagcttccggccttcgcccacaagatccggccgttcatcaaacgcggcggcattcagtgcagcggcgaggtcaagggcttcttccgcccggcggccatgaccacggacgccaaggaagcggccggcgacgcggacgtggtcatggtggccgccatggccatgggccacgaggccatcgtcgccagcctgctgcggcacatgaaggacggctcgctgatggccttcaacaccggctattacgcgggtctgcgcttccatcggaagttcagtcggctgcggcggcacgtcatcctggccgagacggacatcctgccgtacctgtgcctgcggaccggcccgcacagcgtccgcatcgacggcatcaagaaggagctcggcgtggccgccatgcccgccgccgacacgccgaaagcggtccggctgctcagaaaaaccagactcctgcgcttcttcccgcgcaagcacaccctggaggtttccctgagcagcatgaacctgctgttccacgcccccatcgtgctgttcaacctggccgccagcgagaacaccaagggcaactacgtcttttaccgcgacggcgtctcgcccggcatcggccggatcatccacgccatggacgccgagcgcatcgccgtcggggccaaactcggcgtcaagctgaccgactgcgtcaccgccaccaagcgctactacaccgactacaaggtcaggggaagcactatcgatgagtgcctgcggacgaacctggcctacgccaaggacgtcttccccatgcccagcatctgcgagttcgctgtgttccatcaggacctggcctacgggctgccgcccatcgtggagctgggcaggctgctgaaggttcccacgcccgcgttcggaatgatcgtggacgtggccaacctggtttgccagaccgactacgccaaagagggtctgaacctgcggaagctcggcatcgccgggatgaggcggtccggactgctgcgctacctcaagaccggcaggagatgatccgccgccggtgacggaaaggaaccaaccgtgattaggacaaccaggcacgccgcggcattttccgttttggtgcttgcgctgggcacggcctgctgcgccggcgagacggtccggctgaaggccacggccgacatctgggtctccgccttccgcggcgaggccgaccacagcgccggcaagtacaagtccttcaagctcaagagtatccaggaaatggcggtggtgcggttcgacgcggcgcccgcggccgggcggactatccggtcggcgcggctgctgctgcaccccgacggcgagcacatgctccgctacgtccgcgtctccaccgtcagcggcgactgggtcgagggcaccaacgccgcccgcctgaccgccggagacggggccaccttcaaccacgccgacggcaaggccaagcgtccctgggcctgggcgggctcgcaactgtgcgacgtgatcatgggcgcgggcaacaccctgaccacctgggccgagcgcaagcagctcgaggacggctggatcagcgtcgagctgacgccggagctggtctacgccctggtcgccggcgacagcgacgggctggccctgatggaaggcggcacgcccaagttcttcaacaacttcatccactcggtccagtcgaagttcccgccgcgggtcgaggtggagctaggcgagcccattcaggccgccccgccgcggccgagcttccaggcgtcgcccgacccgcagagggcccacctgacgaccggggcgatcaagctgacggtggcgccggcgcccggcgtggtctgctggcgggtggcgctggacggtaagcccgtgccgcgctggaaggtcgcccatccggcccggaagggcccgacgaccttctacctggaggacctggcgccggcgcggaagtgcgagctggagctggtggccgtctcgccgggcggaaaggcctccgccccgaccaaggcctccgtgaccgcctcgccggcgctgccggcgccgccggagctgggcaagttcaacccgcccacataccgcggccccagcgcccccaagccggacacccagcccgggcaggccgcaacgcggggcgcgaggccgttcgtcgcctgggtgtgccctcccctggtcaagatcagcccggaaacgggcaaggtgatgttcaacgacgccggcgacaagggggactggcgaaggtctaatgccatccgggattacagccacgtccgcctcttcggcgcccgcggcgaatatgtctcctaccaggtcatcgtcgagaaccgcggagacaagccgttgaaggacctaaaggttctgccaagtccgctggtccgccccggcgcaaccatcgcccgcggccagatcgagctgtacaagaactggtacgcgcggaacgccaacaagcagtggcagccggcctattgcgtgccgatgaagctaggccaaggcgtggaggttcccgacccggcccgcaagatggcagaccagaaaaaccagtccttctacgtggacatccacattcccaaagacgcaaagccgggcaggtacgacgggctgctgacggtggaagtgggcggctccgggcaagtgattccggttcggctggaggtgctggacttctccctgccggagcggctcgtcttctggccgcagctcaacgcctaccaggcgcccgagggcgtgcacgactattaccgcctggcccacaatcaccgctgcgtcttctacttccgctactggcggccgaaggtcgaaggcgccggcaagaatctgcggctcatctgggacgaatacgacaag

SEQ ID NO: 87 - DNA, 21919 bp, synthetic construct
  misc_feature 1..21919: note = Synthetic
  misc_feature 1..2945: note = n is a, c, g, or t
  source 1..21919: mol_type = other DNA
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccagatgttaccggcaaaatgaaatcgattacggtcatttttgagcagaacgccgttaatacaaaagagttatatcattccgtcgcggcaacaaccggacggcagtgatgactgtccctatttttccatctcggcgaaggtgttgcggaacattatattgaggccataagagtatttgtcccggagcaggttatgaatgacaaaggcgtttaccaggaaaagtacaccaaggccaatttcattacacgccggctcatagatggattcttcaaggcgacgggcgaactgatcgcgggactggacgtgcggaccgcggtcgagttcggctgtggctaaggagtcagtacgcggcgcgtttcaaggcttttgcccgcgggcgccgtctttgaagccagcgatttcgatgagagccgtgttcaggcggctcaagcacttaatccgaacatccgctgtgcgaaagaatctctttacgaacttcacaggccggataattcattcgatctggtcatcgtgctggaagtgctggaacatctgaaaaatcctgaccgtgccctgcggggaatatgccgggttgcccgtaaatgggtgattgtatccgttccgcgtgaacctctctggaggttgatgaatctcgcgagactgaagtatgtgaagtctatgggcaacacgccgggtcatgtgcagcactggtcttcacggacgttcaggagattcgtggggctgtacggagttgtgcgagaatggcgaactcctttgccgtggacgataatcctcctggatgttgagtaacacttcatccatccgcaacgtatccgccgaaaagaatagggaaacttccgggaattccgactcgcgccggccccttgcgcgcgggatgcgccgtccatcattccggcggcgcgtcgatccagtcgtacttgcgggcctcgccgccgattgtgccgcgaggaggaaacttggcgcggtggcggcggaagacatcgtcattgtcagtgggcgacagacgccagcgtgggcacctggccgtggacctggtgcgtcagcgaactgcggcatatggcaagggcggcggccgcccaggatgtggctaccagggggtcgtcctccttggcgtccgtgtaccggttgatccaggcgccgtcgtcgcgctggcgggcgagcagttcagccgcaagggcggcggcccagtcgagcctgccctgtcgcgtctccgcgtcgcggactcccaaggccgcgaaggcgtggctgacggcccaagcccagtagtaataggtcgcgtcgcgaagcacctcgcggtccggctcgaagacgccggggttatgagcggcgtcgaagttccgctccagccacagccgggccgcaaccacccgcgggttttcggcgcccagtccgcagcggaccagcgcccggaccccgtcggccgtcatcgtgccgtaggaatggaagcgaaccagtccgccgcggtccgtccccgcgatcccggccttgttctgcaccgcatcttgcggaatgaagaagaaacccccatcgtcgaagcggctatcggcgccgcgagggtcttccggaaaattctggcaccgccggacaaacgcgagcacctgcctgtaaccgtcgtccgacagcgggaccttcgccgatcgcatcgccgccacgccgaagacggtggccgtcaggttcgactccaccagcaagtcccgcatctgcccctcggcgggctttcgcgggatttccagggagaatccccacccgccgtactgcgggtcgtccggagaccagccgaggtgctcgcttagctgccgcgcccgcaggtacgccagccacgcctgctgggcccgcaggttccgccgcgagcgatccagcaggcacacgacccggctggcggaggcggacgtgtaagcggggaaaagcagttcccgttcggccacgcggattgtcccatcggccccgacgaagccggccaggtactccgtgcccttgcggtagctctcgacggctgccggcccggcctgcggcaggaagaacagcgagctcatcacgtagggcgtgaggctcgggccgtcacggaacatcccgtaggtctccgaccgccacgccccgtccgggccctggcgcccggcgaggtatagccccgccttgtccagcgcgacgtcgatcctggcgataagctccggatcggctcgatcgcacccggccgccagcagcaggccgcacagcaggcccgccggcagtgagtgattccgtcgtaacatcgtggattgctctctagcgtagtgcatcgaatagattgcgaattatcgtgggctccgaattccgaaatccgaagcacgaaattcgaaacaaatccaaatcgccaatttcaaatgttccaaacgccagtgcccggcacactactcgtgaagaacctgagcgcccgttgggggttcttgtttgttttggattttgtattttgaatttgtttcggatttcgtgcttcgagattcggatttatcaggcggcaaaatgtttatcaattctgacacgctctctagcggcgctgaatctttgccgctaccggcaccggcgagcggtccaccatcaacaccagcagcgccgcggaggtgcagaacgtccgcccggtgatgcagtggtgcccggtccagcttccgtcggcgttctggatgcggttcatgttgtcagacatcttccggtcccacttggtccagtcatctccgccctggcacaccagggcctcgccgatggccaggtggctgaggaactcctcgccgccgttggagccgaagccggccaggaagcggtcgtcctcgagcttcttgacgacggcctgcgtcgtggccttaagctgatttcggttatcctcataacgggccaggtccttctcgatcgccgccttttcggcgggctgcgtcgccgccgcggcaagcttggctctcagttccgtctcccgcttggcatcgtaagcggcgttgtcggtctgggcgccgagcgaggaggccgccgcgtaaagtcccacgccggctgagcccttggccgaaaagtcacccgatttggaatcaaatcggtcctgtgcctccttcgcggcccgcgcccggacagtttcgtcgaccttcactccggccatggcagccttgttcattcccttgaccgccatctgttgttcgagcgtctgtgcccagccgccgtcgccccaggtgccgtccgggcgctggttcttctccatctttcgaaccaccttctccagacaggccgtaacttctttgagcaactcctggtcggcggtcttttcctggacctcggcgagcatcgtgcatgtcatgaaggtgtcgatgtatcgcccgagcttcgcctgaatccgcgtgccggcggtcttgtttatcggcagcgaattcggatcagactccgcgacctgtccgcacacgtacttcacgccctcccgcacgttgttggcgtacgtgcccttctcgggcgtgttgcccgctcgcatcagcgaaagcaaggccatgcaggtgtcgccgaggctgggcgtgtctttgagcgatgccccgccgcccatcccggccgactcttctccctggccccaggccccgctttccaactggtgtttggccagccaggccaggccgttatcggcattgacgctgagaggtttgggcttggccgtcgggccagacgccgccttcacggcggaggctggttccgcggccgcagccaagtgcgccagaatcagcgagaccgacagaataacggcagtctttcccattgtccctatgagtttcatagcaagttcctttcaatatggaggtttttcagtttgactggcctcgcgatcaatggcggcaaatgtgaaggtcgcggtcctgtgtctcaatccccggccgtgggaagtcatcggctgcgactgcggcttgatctcgcgaggcggtttggttcatgccaggttcctttcatgcttgcttggatgcgccaagtgcgggaaagttccctgttgtcgatcgccctcgacggtttttcagaccatgccccggtttgtcagacatgaccgggccgcggggaaggggcgcaggtacttcacttctccacgaagccgaacaacttgcgctgctcatcccacatcagcggcaggctgcccgtcagctttcgcggcgacaggccgctcaactcttgcccgcgtaagccagaagcatgttcagcagcggctggagcacgtcttggttcggcagcggcagcttcagataggtctggccggtcgcatcgtcgcggctgagaagaccgcccaacccggctgagatgtcgcgttgcggtccaccgtcggctgcctggcgcagagactgtcccagttggttcagcagggccgccccggccgacaggaggtcgcccactgcctgcggggtgatgatcggcgaacccggcccgtggatgggctgggcctgcttgccggcgccggatgtcgctgaaggcggcgatgggaggtccatcggctcctggccccgcggcgcggctgggacctccgcggcctgtgcggcctggccgttgccgccggctgtatcgtccgagggtatcggactgggaatcgctccggtcgccttgtcgacggtgtccatgaactgcttcagacgcgtgccgcccaggaagacctccttctcgccgccgtccagcaccccggagaacaccgacttcttgaacgacagcagacccaacatgctttcctcgatggtgcccttggcgatgaaatgcaccactcgtaccggccggtgctggccgagccgatgcacccgcccgatccgctgctccaacacggccgggttccacggcaggtccatgtttgccaccacgctggcgtgctggaggttcaggcccacgccgccggcgtcggtggacaggaagaggcggcaggcgggatcctcgcggaaccgcgccaccagatccttgcgcttgggtcccggcacgccgccatggaacatcacgtgtccaagcccgcgtggctccagccggcgaacaatcagttcgtgcatccgcagccactggctgaagattacggccttggcgtctcgatcctccagcacttcctccagcagcgacgccagttcgtcggccttgtacccgtggtcggtctgtttgtccagcaggtaggtgctgttgcagctcatccgcatgttctggagggcgcaggtcaggcgtttctggtcgatctccgacaggtagccgtagcgccgccacttggccacgatacgcgcgacgatctcgcggttgtcctcgtggtgccgcatctgctgatcggtcatcggcacgaagaaccgcttctccagacgctccggcagttccgggagcaccgcatccttggtccggcggacaagcatcggttccagcgtgcgcgaaatctcatcgagcttgcgatagcccaccacccgcccgctctcgtcggtgtgctggtgcgtggccaggaagcggaacatcggaccaagccgatgccggtcaacgaactcgacgatcgaatgcagctcctccaggcgattctccagcggcgtgccggtcaggacgaaggcgtagtccgactgaagctgcttgaccgccttggccgcgcgcgtcttccagttcttgatccgctgggcttcatccaggacgatcaggtcatacctgccccgctggattgcagccaggtcgcggtgtaccacgtcgtaattcacgatcttgtagaacccctcggccgcatacagccgattgcgtgctgccgtcggtccctcgaccacgacggcggatcggccggcgaacttctcaatctcgcgctgccactgatgcttcagcgaggtcgggcagatcaccagtacgcggcggatgtcggcctggcgggtgagtatctcggcggcggcaatggcctcgatggtcttgcccagccccatgtcgtcggcgatgaggcagcgcccggccttggcggcgaacagcgccccctgccgctgataaggatacagcggaacctccagcagcttcttccaggccgggtcgtccgccccgtccgggaatgcccgttcgatccgcttgaccagttcctcgcgatctcgcatctgcgagacaaacgcaagcgcatcgtcatagcagcgaacctcgtgcccatcgcccccgccgtgcccatcgccatcgccgcccgcttggaagcctccgccgccggcctgggccaggaatgtgtggaacagccgcacggcccccggccgcaagacgccattggtatcgaagaacttcgccgcgagactcttgagcgactccggacacttggcgcccggcttgaaaaccacttctcgcttcgccccataccgcagatatacctcgctgaacggttgccgatgcccgccggccagcgccgcctcgcctccgcgccgccgccgcagcctggccagcaggaactcgatatgcttgcacgtgcccagcgtgttggtggcgaaatcggggcacgagcagaagttcacccccaggccttcgccgcgaacggcgacgcggtagatgcctttcgtctgcggattggcgacttcgaattccgagaacacaggccgcccgccgatgtttttgacctcgaattcctgctcagcggcgtattgccggcgcagcgcgacctgccacgcctccagcgacatttcctcgggcttgcgcagccgcggaaccctgcccgtctttgccttcgagaccttcttgactcgcgccatcatgctctccatatgcttctaaatgatcccaaatgctcccaaatgctctccaatcgtccatgccggccgcattgtaacccgcgatgccggccgcttacaaacaaagacccgccggccggatcgccacgcccggtttacacccccgaccgcttcggcaacctcgaccgcccgcccgacctccccgccagcggccaacagggccaccgcgccgacaccggcgacgtccccgccccggccctcgtctgccggtggacgttcatccgggcgtgatgatcccatgcatcagcgcccggaccccaaaatccagaccgtggaatatctcatattgacggtttcgtcacgacagggtacactccacctatcatgccgaacgtcatggggatagatttgggcggcaaggccgtcgggctggctatcgtccagcagccggagaatcgcactctatggtgcggaacaatccatttgtcggacaagatcaaggacctctacgatctccgccgtacgctccgccgagcccgccgcagccgcgtgagataccgtaagcccaaagtcccccagcgcggcggcgggtccgccggccaatcgcaatggagcggctactcttaccgccgcgccaaaggactgaaccaatcccttcggaccaagtgcaagcacgtcgattctgaaaccggcgaggtctgcgacaagaacaccccgaagaacgccaacgtccgccacctgttcctcgacgacatccttagctacgccccatttcaagccgtgcccgatgaccacaagcagtccatccgcgaggtcctcaccagccgcgatggtatagccagccggcgcgagcgtctggcggatctccttgaccggctcaccgtcaaagcctatctcaagaagcagataaaggacatctgtttcaatgacctcgacggccgcgcggagttctgcagcgaccacatcctttgccaccacgcccagactgacgtgcccaaacagtcggcctggctgccgccctcgatccgcctcaagcaggatttcctcctgaagaacatccgcgaactggcccagcttttccacatcgaccgcatcgttctagagcgggccaacttcgacctccagaagatcgccgccggcgtgattgaagacccatcagagtaccagcagggcttccggttcggttcccgcaacacgcggatggccctgatgcaggaatacggcgcgcgttgctgctactgcggccagagcgtcgccggccagaaatggcatgttgaccacatcgacccgcgccgcgctggggaggccaaccggtgggacaacctggccatcgcctgtgaaaagtgcaaccaccaaaagggaggccgcacgccgaaggacgccgggatggccttcgccgtcatctccgagagagtcgccgggcggatgatacgccgctccctggagccccaccccatcgagggaacccggatcaacaagtacatgacccagaccgaccagggcatccgcatgctgaaaaacgccctccgggagatcttgcccggcgcagagatcgaggagactttcggctacgtcaccagcgcctggcgggagttctggggcctcgaaaagggcaaggaaaaacaagagcaccacaacgacgccattgtcatcgccgccgaccgccgcggcggcgcgaagcccatcgtcgaaataattccactggccaatcgccagatcgtgggcggccgccgcctgttcgaccttaaccccgttcagcgcgcgcccgacggccggcattatcagcggacccccgtcgcggccgaggtagggggagtctcaccgagccagctaaaggccgtggtggaccctcgaaagcgggaacttctcacccgcgaattcgcccatcacggcgttaccggcaataagtcgctcccgccggccgcgctggaacgcctgccgttcaccagcgtccggctgcgaaagccggactgcaccgacaccaacgtccgacagatcccatccggccaccgctttaagttgagtaattccggcggcacgcgcgtcaacgaggcggccgtcgtctaccgcacaacggccggcaaggtggcttcctatgtcgtgaagaaccgcttggcctttgggcagacgccccttcctggagatttcgagagggaactttggcgtgcaaaaccgggcgacgtattgtacgatgctggcggaaaccccttcggaagcgttacgaagatcggcagcaacggaaccatgaccttggatacaggaaaatcaagaatggcacatcggtgccggaagggaggaacatagagaaaagccaagaaactaccgcgcgaggcctcccacgcacgggttgaagcgagttttctgcccttgtggggctcctttcctcatcttggcctcgcacgcacgggacgaaggcaacgagacagagacagacagagcgacgccgattttggcctcgcacgcacgggatgaaggccttcgcggcgttcgatgcctggctgaaagagattttggcctcgcacgcacgggatgaaggcaaaatgatgtgccacacgccagatatattatattttggcctcgcacgcacgggatgaagggttccaacgccgacgccatgatcgccgagaagattttggcctcgcaggcacgggatgaaggccaaacaaggctacatacctctcgcccttcttattttggcctcgcaggcacgggatgaaggaacgatcatgccgctgaatgtggcgtttgaacaattttggccttgcaggcacgggatgaagtacgggcctagataacatctacggctggcgtcgcattttggcctcgcaggcacgggatgaaggccggctcccgctcctctccgttgatcgccacattttggcctcgcaggcacgggatgaaggctgacatgttgttgacgatgaggaaagaaagcccaatatcttgtggaatagccggtcagaagtcctgcgcgaggccagccgacagattcatcctgtgttcgcgaggtcaaaagcagcctcagcgaaggccccgttcggggcctgccggggaacccaacgaaaggcgggacccggccaatagctacgtttgcaggaaagctgaagacctatgccgggatatagtgccccatctacccagtcccggcctcttggagtctcgacccggaagatcaacgccccatcggttcggccgggggagagaaaggtcctcgtgaggggacatcgcgtcgggcgaccacgcgacgcccgccgaaaggcggacgagacaagtcgagacatgtgcttcctgtaaacattggctggggatagacgggatttattattggcgccgaaacgacgccgctggtgagggtctgccccgtcgcccgtcggcgcgatcgccacccgattccccgcgccacatccgccgccttggcccggtccagggccgcgtagtcgagcgtgacgtcggcgtcggcatggccgagagacgcgcgtgccgcgtccaggccgaagcgttttctaactcgcgtggcgaatgaattgcggttctggtggcttgttagagagatgatggtggtttttcggaagataacggatgaggaattgaatgccgatgtggtgaagtgcccctacccagtgagctttgatgcttctgaagagaactggggcagcctaacgcacatcagcgagcgccacgtcccgagcggcctataccgcctcagggccaccgggatacgagtgcggaacgaccttacaaatgaacagaagatcgccgtccttgcacacgaaatggcgcatgcattagacctcatacaaccatcaactcttgagcacatacaagacttggcgagaaccgagatggttgcgtatcaggagtgcttgcgttcattactgaatcgcggcctctatcttccgcttctatgggaaatgtttgcgatcgaatgggacgcggaggggcagggcgagtgtatctatagtagaagcgccgcccaggcttgctacggatcccaactttggaatgaatgccgcaacactctcctggaagtaatgaataatgcgatgccacgcgtgcttccggcaagtgtctcatgggaagggcatgaggatgttaagctgattggcacaggggggccaccgttggtggtagcactaaaggacggaagaatcgtggacttccagatagtaaagaattggtcgcccaagagtcgaggcgaagcgtcgtgaatctcccctgttcctcggctcgctctcaccggattcgccgcgcaatcgccgcgccgctcgtcccgtccgcatccgcgatcatcggccccggcccgcgtaggccagaagcaggttcagcagcggctggagcacgtcttggttcggcagcggcagcttcagatagggcggcccggggtagacctgcacgtgggcgccgcgttccgcgtgggcgccgcgttcttgctccaccctttatatcttcctgagtctcagttcaagaacgccgttgttgtaggaggattgtatgccctccttctccacacaggcgggcagcagcacctccgcgtgatacacgtgatcccctttcgttgaaatcgtcaacacatcgccgttgacctggtaggcgatatcgccttgggcaaccccgggcaactcggcgatcacccggatcatgtttccttcgtccaggacatcgaccacaggctccctgtcttcctcgacggccatgccctccttggtcttatggatgttcccgaacggctggaccttgacgccgcggccctcgccgccggccatcgtccggatggaaaagccgaagatgcccttgcccttttcacccagcccagggacgctgaactcgccggtccggctgatcccttcggagtccttcagtttcccggccgcctcgaccagcttctgtatcccctcgaaaattccacccaatccgaacccgacgggggcctgggcttccggcttcttccgcttttggtcttttctggccatgttattctcctcgcaagagttgttcgaagttccgcgtaacagcgcgatcgcgccatccgccatcgcctgccttagtccgttttcccacaatgttgtcaggccgctcggcctcgtgcgccaatacatatcgcggccggcttgactgccgcgcttagcttcttcaaggaagcttccagggccttgccggccgcgacgattatttcggtttcgccgccggccagggcgtctcgcacagccgacacggctgtttcggcggcctcctggagaagctgcacggctggggcctgggcaggggcaatccgggacgcttcgtcaataagctgctctgccgcccggatcaggttttcggcccggatggctgcctcgatctcttcccgtttgcgccggtcggcttccattgccgttcggctgtccgccagcagtcggccaacggtctcctcggagggtcgcacggccgcctcgacgcgaatgcgcctggacgtgtcggtttgcagatcggtggccgacacgtgaatgatcccgttggcgtcgatatcgaaaacaacctcgaccttggcctcgccgcggacctggggcgtgatgccgaccaggtcaaactcacccagggccatgttgtcggcggccatctctcgctctccctgaaggacgtgtacttccatgaccgtctgatcatcccgcgcattggtgaacagccggctgttccttgtcggaacgggggtgtttcgttcgatcactcgcgcgaaaagcccgccctgggtctcgatccccaacgatagcggcgtaacatccaccagggtaaccttccggacctgcccggccaggacgccggcctgaatggccgctcccagcgcaacgaccttgtccgggtcaacgtgcccatatggctctatgcccgtgatctgcctggcaagccttcggaccgcgggcatccgggtcatcccgccgaccagtacgacccggtccaaatccatggggtcaagccccgcatccgccatcgcacgttgcgccggggccaccattttctccgtgaggtcggccgtggcggactcgaaggcatcacgagtcaccgtcaccgcacaccggctgccgtggccgaaggaatgaggcaggaccacggacgcctcgacatcgcttgagagcttgatcttggcttcttccgccagttggcgaaggagccgccggcaggccgggtcgccggtgaggtccacgtgccatcgctcgcaaaaacgctccgccagcatctcggcgaggcgctgatcgtagtcatccccgccgagccgcgtgttgccgttgacggccttgacctcaaagacgccgtcgccgagttccaggatcgacacgtcgaacgtcccgccccccaggtcccagaccaggatggtgtgcgctttttccatgtccagaccgtaggccagcgccgccgccgtcggctcgttcaccaggcgcaccacctccaggccggcgatggatgcggcgtccttggtcgcccggcgctggctgtcgttgaagtatgcgggaactgtgacgacggcgcgctcgacggactcgcccaggtaggtctcggcgtccgctttgagtttttcgaggatcatggccgagatctcgacgggcgtgtatgcccggccgtccaccttcaccatgtagtcggagcccatctgtcgcttgatggaggaaacgaccgtctcgaggccgccgccgcccgcgcaggtgctacccattcgccgcttgacggagaacaccgtcctgagggggttggcgacggcctgcgcccttgcgattcgacccacccatatgcggtcatcacgggcaaaggccaccacggacggcgtcagcgcctcgccctccaggttggggatgatgacgggccggccgtccttcatgtacgccgccagggaattcgtggtgcccaaatcaatgcctacgatcggtcccattccgcacgttccttgccgtaaggccttttgcatttgcaaatgcaaaaggcttgtccgcttcgggctcacctgccgttgccgggccgccctgcctgcgtgtccgttcatgccgttgccgcgattcccgcttgtgagcctggcagcaccccattcggacgcccgtctcgcaggagttgccgctgctcgggcggcacggcccgaatggcctcgtcccaatccgataagatgccgtatttcagcagggtttcggtgccggccaccgccacgctcaacgtcgcgccgatcagcggaatgcccgccagggagatgaccagatccgctcgcaggaacagtcccctgtccaggactctgtccaacaggtccacgatcgttgcgcggcgatacgctttgggaagctcgggttccataatccctatccttgctcggcaacaggatgccttggtgttcacccgccgacgaaactgtacggcggccaaggacccgtgaatcgcacacggatgccagcggtctctttaatcttgtccagtacgcgacccagctccttgccgccatcgggcatcaggcaggagaggttcaggagcatctgcttgccgccatcgtccttcttgagcttctcgacgcgcacatcgtccacgcatcggcggatgcgagcgtagaaatcctgggcgaacaggtcggcttgcgtttccattctggcgcggatgaccttggccagcttctgcccaagaagatgagccatgcctttggatttctcgcgggcctcatcctgtatcttgcgcagctcatcatcgctctgaaccagcgacgccgcgatcgcctggcgatcccagagcacctggactccgtattcggccttgcccgcgagccgctcgagcaactgggtgaaccgctctcgcttctcgtccagccaacccttgagcgccacgatggccccgccgtcaagtccgccgcgcacgatgatgtcgaacgccatcggcaagacggtcccgaaagccttcgtcgccgcgcgtacgacgctctgatgggccaacacccagccctccaggacctgaggatcctgggactggtacggctgggccgggcagttgtgaacgatggcgcggatgtccccgctggccacggtataaaccatctgcccatccagcccgatcgggccgagcaggcaactgccgtcgccgcgagccacgcagtagacgtacaatgcgtcctgcgcgacggccggcggattgccttggtctttatttgcaaagatcatcgtcccgcccccacaggcttctggcccccggcggcgaccaattcgtcgcgccacgtgctcgggtcgatcgctcgctggaccacgtcattgacgatgtcgtccaggccgtcacgaaccgactggacggcctgttcgagtccctgctcgcgcttgatgccctcgatggcaagatccaggtccgcaagggcaaccccgagacgctcgacttcctcgtcgctgagcgagcccgactcgattcgtcgcgtggcctggttctggagggcgtcccggaggatttccaccaccgccaacaccaggcccagaacgccgtttttcaagctgtcttggtctatgttgatcattgcttgcccgccttccttatttggatgttcaggatgccgttagacaaggacatctccggcttgccgaccacctcgcaaggcagctcgatccgttggaggcccccgcgatgggcggcctcgacggatatcaacagcaccgtgccctccagagaaacggtgatgtcctccgccttcaagcccggggcttccgccagaacgacgatcttgctgccttcgtcgaagacatcgacgtgaagctgcgcgggcgtttcagggctgatatggactttttgcaaaaagggcggctgaggctgtcggtacttgccgcggcggacaccttttccagaaggctttttacaaaaggcttcgcaggcccctgtcgaagcggaccgtccaggccgtccgcgccgcacggatgggggtatgcccatctggcggcgaccgaggttgccggcgattcccaaggaggcccggttaagcggttgctccttgaacttgcgtttgacttcctcgtcgatagcggcaaggcgctgctgaaactcaggcatccgcgatgcggtctcgatcaaccttcccagtccggggaccagttttcccagagcggttacaacgccctcggccaacccctctgccttgccccggggttccttggcgtcttcctggagcttgcggaggctttcctgcaattgcctcacctgctcacgcagttcctctgtgttttctttgcctggccttgtcttcgacatcgtccactacccttcatcgtcggcccgcgccggtctgcgccgcacgtgcttccggcggcctctacgaggcgaccatccgcttcttgatcctggcgggcatccagtcgcaccagggacagccccgcgacaggagttccgcctgggcggaacgtttgccgcattgcgggcagtcatccttgattaccacagcctgtttccaggcctcggtgtcgaggttcgatcctgccggcagcgcaaggccgtacctggccgcggtctccagggatgcaagcaccgcccggatcctgatactgagcagctcgacgccggccagggacaccgcgatgtcggcgttgatcaccaggcccttgtcgaggacccggtcgattacgtcggcgagcgtgtcggcccggacggaatgctccatgctttgcttggcggggctcatcctaagcctccccatccgcaccggccgtcatcgccaccacttccgcccgccggcgcatcccgacgcgcgtgaagtcctgaacgtagccctcgtcatccacggtcagttcgtaagtggccaggatgtcctgggagtcgggtatggagttcttctccaccacctccacctgcacgcaccagccggatttgcctttgccgaccgagaccgtgctgcccaccttcaggccggtgagatcgtgaagctgttcccgcgcccttgtgaccaagtccagcaatgccattgtcatgtgtctgctcctttcgatcagaagcgagtgttttttacaaacaagccttctgcctggattccttgtatttgtggatttcgttcagccggcgcatcaacgcgttttcctgtttgatgtactcatcctcgccgatttgctccagttccagccgggtttgaaggtccagcagccgctcacggatgacggattcgtccgtgacttccgccagggcctgatcgtacagggtccgcccgatccaggtaacgaacttgcacggggccaggaggatgtcgtcgaggatgaatgccatgttcagtcgtcccaggtaatgacaagctccaggaaattgcacggcggcagggggcctacgcagcgcaacttcacttggcccgcctgctgggcctcgaaggcggacaggacggcctcgatgtcgttctggcgcgacttgtccaccaggagcgccaggttcgcgaacatcggatcgccgaaggtcttgttcctccgggaatctttcgccaggggcgtcaggcgccgcatcagggcggcctccgtgccgcattttccgtcctccagggcttgcttgaccctctcgcccagcttgatccggccggtcacgttcgtcggggccttgcgcgcggacccccggtcgccggcgggcagcagcttcttacgcagcgattggatctccgggctgctctccacgatgtcccggaataccgcctccatgtttgtccacaggcccttgacgccgacctccacgagggggcgcatggtcgtcaacaggccgagaatctcgtcccttctggcaacaagcacgcggtcgatgatccgctgcgcggccgtgctcttgcccttgtcttcggcgatcgtgttgaaccggactggcaggacagtgtggccgcgctgcatgaccgcttccatcacccgttggtgcgccagggcgttttcgcgcgagatttccagtttctcccgcgccgtggcgctgacgacggcggcaatgccgttatggggcacggcgaacacttccgattgtccgtcgatgcccatggggccaaaactgccgggcacgccgctatcgatgacgcaatagatgtagcgccgcggcgcccgcggcttgtccgtggtgaaacaagccggttcggcttcaatgcgcggtgtgtcggttagtgtggccgtggtcatcttcgttttcttcccattacgccgccgcggccccgacgcaatcgccgcgccgagacggatctcgccccgtggacactctcggaccggccccttttgccaaaaggttgtcgagggatctgaccgtaacgatcacgggactcacttgggcggcgttgaacgtgtgtttgaaattcaatgcgtattcttccagaagctcgtgtgcggccgagatgtcctgaagtcgttccgcggccccggcctgcgtgtttctgtcggggtgcagctcctggagcagccgccggtatgcgcctttgatctcggccagactggcggattcgcccagtccaagcagccgcctggcggcatccagccggcttgcctggatggtcttgacttccgccgtcgcgaaactgtaggggggaagcggtccgacacggcgaaacttgagccggtcatcgtaagagcggttcaactgctccaggacccggtcaaactcggcttgctccgcgcgatcgatcagcacggcggcgttgaggaccgccgagtcatccctcgtggggttgacgacgatgttccgccacttggtccgcagcgagacgaccagaccgtcggcggcggccttgttcttccggtcgagcagctctttcaccaactgcccgaggcggatgcgctgctccacggtagcttcggcgtggttgtcgatccgggccttcatcgagatgacggcctcgtcccgggcgatctcggcaaggatggacttcaggtctgcccaggagacagcgacatcgaactcgaccttcccggcatagctttccagggcgccggcgaactgcttcccgccgcagcggagtatcctcacgacctcggcatcgttccgggctttttcgcaaaacgtcccgaacttcaccgggacgaccgtgcagtcgagcatgacccgctcgaggacacgctgatgctgagcgaggtactgaagcgtcttctcgggcgggatctcgaaaaaagcaacgggggcggtcgtgctgatcacaatgccgatgccgccgtccgagacggtgcggacctcctcgccgtccaggccgatgggcccgaagtccttcgcctgatcggctggaacgacgccgtagagatagctgcaattcgatgtcatggtcggctccatattccgtcgtcttttcaggccgcgaatttcctgatgagcgtctcgacgtttaccctgatggaagaatctt

SEQ ID NO: 88 - DNA, 16158 bp, synthetic construct
  misc_feature 1..16158: note = Synthetic
  misc_feature 1..9498: note = n is a, c, g, or t
  source 1..16158: mol_type = other DNA
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggtggccgtccaggtgcgtcgggcgcccgtgccgctccggcgcccagcggacctgggcgtcgcactcggccccgacggccgcggccgccgccggcatgttcgccgtgatggtcgtcgacgtcgcgatcccctcgcggtgggcgcgccggacgccctccgtgacgccgccggagaacccgaagtcgtcggcgttgacgatggcccgcttggcgttgcgcgccgcactcatcccggcgcggcctatcgtgcgccgccgcgcggggcgacaatccccattcctatattggcgattcgacggcctcaagcgccgggacgtgtggtcattgtgtcgacatttaaaccgactgacacaatcgcttcgcgccattaccatctatattacatagctttagatatcctatcactcaagcgggattccggagggcagtacaatcagcccttacatccgtaatccccagtgcctcatcgtagcttctgccccccgaggcggccatgggtcttgattgctatctgttaccagtccacgtccggcgtttcccagggggtcggaatcaatataagacactacattagaatctcttatccccgtccccccttcggacagtccgcctccccgccgccgcatttgcccgcgagcggccttgcggaatcccctcggccccgctatgatacatggcagccgcgatgttccgatcgcgtggcacttcggcgcatcgccggaacgggaagacgatcatgccgcccggattttccttgtcgacgcccgggcgcggccgtatgctcccaactcatggtggccaacgccctggggatagacttgggcggcaaggcagtggggcttgctgtgctggagcgaccgggcaaccgcgtcctgtggtgcggaacggtccacctctccgacaagatcaaggatctctacgaccagcggcggacgctgcgccgggcgcgccggggccgcgggcgctaccgcaagccgaaggtcccccagcgaggcggaggatcggcgggccagacccagtggagcggcttccgctaccggcgcgccaagggcctcaaccagtccctccgaaccaagtgcaagtacgtcgatcccgacacgggcgaggtctgcggaaggaacacggcgaagcgctccaatgtccggcatcttttcctggaggacatcctcggcttcgcgccgttctcggacgtcccggccgactacaagcaggccatccgcgacgtgctggcgtcgagggaaggcatcgcaacgcggaagcagcgcctcgcggccgtcctgagccggatcgacgtggaccggtacctcaagaagcagatcacggagatctgcttcgacgagcgcgggggacgcgcggagttctgccgggaccacatccccgcccgccacacgcagaccgccatccccacgcaggccgtctggctccccccgtccattcggatcaagcaggacttcctcctcaagcatgtccgccaacttgccgccagcgtccgcatcgaccgcatcgtcatcgagcgcgccaacttcgacctccagaagatcgcgaagggagtgatcgacgatcccgcggagtaccagcagggcgcccggtacggcttccgcaacacgcggatggccctcatgcaggagtacggcgcccgttgctgctactgcggcaagagcgtcgtcggcgagaagtggcacgtggaccacatcgacccgcggcgtacgggcgagacgaaccgctggaacaacctcgccatcgcctgcgagaagtgcaaccacaagaaaggcgggcggacgcccctcgatgcgggcatggccttcgccgtggtcggcgagaccgtcgccggccggcgcatccggcgccggctggagcccaagccgctcgccggaagccgtatcaacaagtacatgacgcagaccgaccagggcatccggatcctcaagcgctccctcgccgagatcgtccccggcgcgcccatcgaggagacctacggctacgtgacgagcgcctggcgggacctgtggggcctggagaagggcagggagaagcaggagcaccacaacgacgcgatcgtcatcgcctccctgcgcgaagttgccgccgtccccatcgtcgaggtctcaccgcaggcgatccggcagaccgtcggcggcaagcgcctcttcgacctcaaccccgtccagcgcgcgcgcgacgcgaagtactaccagcgcggcccggtggtcgcggaggtcggcgggatcgcgccggcccaactgcctgcggtcgtggacgagcgcaaacgcaagctgctcgcccgcgagttcgctcgctacggcgtcacgggcaggaagccgctgccgccgccggcgctggatcgcctccccttcaagagcgtccgcctccgcaagcgcgactgcacggatgccaacgtgcgtcggatggcgacgggccaccgcttcaagctcagcaaccccggcggcacgcgcgtcaaccaggccgtcgtcgtgtatctcacgtccgctggcaagcgggcgtcctacgccgtcaagaacacccgggccttcggcccgacggcgccgcccgacgacctcgaccgcgagctgtggcgcttccgcccgggagatgcggtcgccgatcgggacggcggcgcgatcgggcgcgtcgtcaagctcggcagcgacgggacgctgacactcgattccggcaagacacgaaaggcacacacgtgcagcaagggaggtggtcgaatgaccacgagctagacggcgcgaggcctcgcctgcgtgggacgatcattccgccgtcttctcacgagggcggtagggtaattctggcctcgcgggcgtgggacgatgtggtggcgttgaaggtgaacccacccaacgcagattctggcctcgcgggcgtgggacgatgtcacgaacgaccggatcctcgaggccgtacggcattctcgcctcgcgggcgtgggacgatgggtttgatgcggagaccgtcgcggctcttgtaaattctggcctcgcgggcgtgggacgatggccagcaagtttgatgccgcgcgtcacgggactattctggcctcgcgggcgtgggacgatgggaaagttgactaactgaaagagtgtgggagacattctggcctcgcgggcgtgggacgatgcgcttcagtttctcgaggaacagggcgtcaaccattctggcctctcgcgggcgtgggacgatgtggtagccaccgtaccagaagttgaacgggtacattctgggctcgcgggcgtgggacgatggaacgccaagggcatcgccgccatccaggagaagattctgggctcgcgggcgtgggacgatgactgacatgttgtgtgcgaggaagccgaaaagccgaccatcttgtggattcgccccgccgaagtgtccgtcgaggccggcagccgaaatgagcccgcgttcgcgaggtcagaagcagccagagcgaaggcccccgatggggcctgccagggaacccaacgaaaggcgggacctggccagcagctacgtttgcaggaaaggtcaagacctatgccgggatgtagtgatctcgtctacccagtcccggcctcttggagtctcgacccggaagatcaacgccccagcggttcggccgggggagagaaaggtcctcgcgaggggacatcgcgtcgggcgaccgcgcgacgcccgccgtcaggcgggtgagacaagtcgagacatgttcttcctgcaaacattggctggggatagacgagaaccttattcgcccgcatgatgcgagcagattgccacgcaggccgacggcggcgctacagcgccagcagcgccccggagggtgtcagctggcgactgcgctgaagccccagcacgggcgcgcggcggcgcgcagggcgagcttcatgctccagcccgacgagatcatgtgatcgacgacgagggcggatgagagatccccggcttgggctccgttcccgggctctgccttgaccacgccgcgggcatgcggtatcatccgcgccggaaaggggatcccctatggaacctgccaaggacacacgactcgagcagggaagctacttcgatgcctacagccatttcgccaggacactgcgcctctggttcatcgcctacggcgtcggcgcccccatcgccatttgctctagcgaccgtctcttggacgccgttgtcgctgcgcgcagtctcaaccccgtcgtgcctttgttcttcgctgggatcgcggtccaaatcatgatggcgatgatctggcgcacggctctctggtatcagtaccgggccgagtacaagccgaactcaatgagcacctggcgctaccgcgcttcctgccggatctccgaccagtactggcttgagttcctcgccgatctgtttacgctcgtcctgttcgcctacgcaacctgggtcgccgtctcggcgatctgtatgcacatgtccggcacgcttccgggatccgcgctatcgtaatcacgggatcgcaacgccggccgaaccgtcaatcgaagggaacccaccatgaacctcaaggagttcatcacccagacgctcacggagatcgccgaaggcatccgcgatgcgaatgagcccgtccaacaggccgggggacgagccgtcccggcggttgactttgtcgcgttcgatgacgacaggcctcagtcgccgatccagttggtcgacttcgatgttgccgtaacagcacaggaagagagcgctacgaaggtggggggcggcctgctcatcgccgggatcggcctcggcggcaagacggagacgcaagcacaggctagctccgtcagccgcattcgcttccgcgtgccgatgatgctcccgccatcctacaaccaatgagcggccgggtggcaaggcgcgcaccgagtacattgacgaagggaacatcgcggttcggccaagccggcggactacgatcgacatctgagccgcggcgcgcctcagcacctcacgggggcgaagccctagcaggcgccggcggctgcgcggaggccggggccgtctgtggcgatcgtcgagcaaccttgcgggggggctgcgagacggctacaaacgcggcaagggcagagtagggcataggtgggatagagaaagggcgagcagatgccgaacaacaagaagctcgggacccccagaccgtggactatggtgatggtggcactctgcatggtcatcgccattgtcctcattgtcttcctatactgcgtctataccagggaggcgagctgcacgccgcactcctttccttcggtgcgtcggctccgcagcccaaggcaatcggcctggatgtggtcgccacggtcgagggcttctacgcaagggcgtggacgatgttgatgggagccggcgggatggctggcgtgatcctcctcgtaatcgtgccgcttgtcttgcagcgcctccagtctcagtccttccgagatcacaaggaggacttccgggaacgcgctgcggatgacaccaagaagctccttcaacggacacgcgaggaactcaggaccacgatggagagccacacgaagaagctccttaccacgatggagagcgacacgaagaagctccttgaacggacacggggcgaactcagtaccagcatggagagcctaatgctgggatacgctctgtgggggcaggcaaatgccagaggcgcagacgaccagcatatgcgcgtcctcgacttccttaaagccgcacaagccttcaagcgggccaagaagccaggcctcattgcacgcgccctgcaatgggcccagatctgccttggccggcgggctgtaaatgtcgcagtgttcgcccaggatgccaatctagagagccagatacaatccgccatattggggcttaagctgccagacaacgaaacccagggtctgcttcgctcccttaacgaggcgcgcgagcgtcctgcgcctgggtcggaagactcaagggcagagcaacccgaggggcccggaccggagacggcggagtaacgacaagaggccctcttccgtgccgattgcgccgggctcgtcaagaagccagcggcgggcgagctgggagcggggtgaggctggttgctcgccgtcggcgggcgccaggttgaggcgcagcagagcgggcaggacgttctggtcggtctcggctccgcggcagcgtaggtagccgcgacatggcgatgaagcccgcgggggtcattcccccggatgcgctgtacccgctcatacgcggcattatcgcgcgggcgaggctgccgggcaagggcgcggatcagcccgctgcgcgccgcgcggccgcgtggggccggcggggggcctgctcgcacacgagggaggcatcgtcgcggatggtgctgtcgaggtcgtcgggcggcgagtctcccgaacggcgagatggccgggggctcctgtggctgaagccgccgatgggaagcccgttgaaacgggctaagcttcttcctggccacgtgttaccatggctgaagccatggactacaccccagcttgctcggacaggtggcgctgtagtgctgagctgcctggaggaatggctgagctgcgtgcaacgtttggtgcacgcagttcagccggcgaacatctgccgcaggacctgggggacctggaagaggcagaagtaggcgaagacgaggaacgccaccagcaggacggcggcgtggtaccacc

SEQ ID NO: 89 - DNA, 13627 bp, synthetic construct
  misc_feature 1..13627: note = Synthetic
  misc_feature 1..8170: note = n is a, c, g, or t
  source 1..13627: mol_type = other DNA
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccggcctggccgcctcaggagggcctgcccgccggaggcgggccgttgctgttgtagggcgggcgtgcctacgcccgccggatgttgcccgtccgccatagctttagcgacggcggaaacttcagcgaaggcgggttccggtggcgcagaggcgcactctgcggccgttactgtcgctgtagggcgggcgtgcctacgcccgccggatgttgcccgttgtagcgcgggcgtgtggctagatcgcctacggcgaccgctggctaggttggcctacagccaaccgccatggtggccctcgggcctagcgacatcccggtccgaaggacttagggacctacgcccgccgcggtgggagcccggtcccccgggcgactgcgctcgaagcgaactctcccccgtagggcaggagcccctaggtccgccaaagccggccggggtggcggtctgcctttggcagacctagccacgagtctcctgccaagtcgtctgccgttctgtagggtcgggcacacccttgcccgccggcctgcccgccggaggagggcctgcccgccggagaaggggcgtttccgttgggcctgggccagtttaccctgagcgaagtcgaagggcctcctggcacgtgcggtagggtcgggcgtacctacgccgccaaccttgtgcgtagacaggaaggtgattgcctgtagcaagacgaaggtgttcaatgctatactttcgtcactcgagagacggagtcgcaccttgacaatggatgacgctgcccaccagggcgggctttagacggagagtgcgaactgctgtttgctatttcgccctcgcattggtggacagcacgagctggacggtgttgccagcgccgatctcgaggccatttcgccctcgcattggtggacagcacgccagctcgcgctgtacaacgcgcagtgggttcatttcgccctcgcattggtggacagcacgcaccaggccatccaccgggtggcctgtggcgaatttcgccctcgcattggtggacagcaccggccgaggcgtttttgaggtatctcgtcgagtaatttcgccctcgcattggtggacagcactgttggcctgcacggtctgctcgacgtaatcggtaatttcgccctcgcattggtggacagcactcacaccaggccatcggcaacggtggcctgtggcgaatttcgccctcgcattggtggacagcacgctgacgaatgtggccgtcgcgacctgggacggatttcgccctcgcattggtggacagcacggccgacgggcatatacccctgtatgggatgcaatttcgccctcgcattggtggacagcacggttgtgccgagactccgggtcggctctctctcatttcgccctcgcattggtggacagcacgtcggcgagcaatcagcgtcccccgaaggaggaatttcgccctcgcattggtggacagcacgggttctggggcgatcagcgaggggagcgagggcgcgcgaggaatgagttggggacgcagtaggtatgtataggtttccaccagtgttgaagggcgaaagcagcccagccaagtctccgcccatggcggagcacgggaaaccggtggggaaacccggccggccaccgtaaggaggcacgtttggggaacaggtaggggtaaccctgagtgcaacctggggtgcaccttcagctccaggctctgcaaggctcggcccagaggattaacgccctaatccgcctctggcggaagggagagaaaggcggtcgtgaggccgcaaggcaagccgagccatactcctgtacccaaacctgagcgggaaggagaacaagtgaatacggaaacgcgagagcaggtgttggggattgacttcggcccgaagcacgtgggaattgctctcgtggcgaggggggcctcgtcggaggaagtcctcttcgtcgcggaggtgcggctgagggaccgcaagtcgctgctggccgaccggcgggcgctgcggcgcgggcggcgaggcaggaagcgctaccgccagcccaagattccacagcggggcggtggcgcgacgtcgcaaagcggcgaggagagcgagagggggcgcgccgcagccccggagtatcgtcgcgccacagggctcaacacagggcgacgacgctgcaagtttgtcgacccccagacgggtgaaatatgcgggtggaatacgccccgcaaggccaacgtccgcgacctcctgctgtggaacatctgccgccaccttccggtgtctgtctccgagcaggcggggttcctcgcttacgtcaaccagacgaacctccaccgcgcggagatactgggtgctctgccggcggaagagcaggccccgctggaggccgtgttctcgcaacagcggcggccgaaagacgagcggctgaaggaccggctacgaaggctcggcgttgaccggcacctgcgctcgcaggtcacggacatcgttggcatcacctctcgccggccgctcagcgggcggctgtctttctgccgcgagcatttcctgcgccaccacgagcagagccgcgttccccggcccagcgtgtggctcccgaacactgttgagatgaagcaagcggatgtgctaaaggtctgccggcaggaggtcgcgccgcgctggcgtgttgactgcatagtgctagagcgggccaacttcgacttgcagcttctccggcagcagaccgccatcgaatggtcggtggaggactggcagcgcggcccgcggtggggctaccgcaacaccttcgaggcgaagaagcaggagcaggggaaccgctgcgcctactgcggcagcaagccgacggcgaagaaccggctgaggctggaactggagcacgtcattccaggtgggggcgacacgtgggagaacctggtgctaagctgccggaagtgcaacgagggcaagggtaatcgcagccctgcgcaggccggcatgcgcttctggacggacaccgagacgggagagacgctctccccggcgccgctcggcgccgcgcacgtttcccgctacatgacccagacggaccaggggtggcgtcgccttcaggccgcgctacagcaggtcttcccccaggccgcagtcgagcacacctgggggtacgtgacgagcttctaccgtaaccgctggaacctccccaagaagcacttcgtggacgcggccgtcatcgccagctcgcacgagcttgagcgccccgtgtccgtgcccgaacagccccagcggtttgctccgacatccggcggcaagcagctcttcgacacgaaccccctctcaaagcggccggaggggcgcttcgctcagagcaaggcgattgtgtgcgagcaggggacgctcgccttcaaagatgtcgccaaggtagagaacccgcgcaagcgcgccacgcttcagcgcgtcgcggatgaggccaccgcagcagcaaaggcgcggggcgaaaccccgcccaccgcgttcaccgctgaaatgctgccgaagataccattcaagtctgtgcgccttgccaagcaggacgctagcgacaccaacacacgccgactcggccggcattggttcaaggtcgcaagcgccgtgaatatcgcgaccatcgtctaccagctcgacgggaaggtttgcatgcaactccaacgcaaccccgcggtcttccgtcatgaccctggcttgccgcagggggcgcgcgttgtcgccaccttccgcaagggcgacctggtggagtgtgacgcgggccgcggtcgggtaacgaagaaccacagtaactgcactctcaccgtcgaactgctggacagtggcaaggaggtgacgaggctggcgaagtcgttcaggccgcggcatggctaggatgtaatggttgaccaggcggtgggagcccagttcgttccccacgagaagacaacggttctccccccgcgcgcagggccggcggggttcggcttccccgccctacactcggcccctccgcgccctctgcgtctttgcgcttgcccgcctccggcggggtgaactgccgttgccgttccgcctcctctgcgccatttgggtaatctgtggtccccccccggccgttctctgtgtctttgtggtgaactgccgttgttgttccgtctctgcggttcaactatttcttcccccaaaatctaagcagctcttgacaaacccctcttgcttgcgaatctgccccacaatgcccctattcgagcgcgcgcgtttccggtcactaagaggacgctaagagaacgactcgccaaaggaccccgcgggcccgtcggcaagccgattctcgactttcgaccttcggttctctcccttgccctcgctcctggagtcctctatgccccttgtagaccgaccgcgaaaacgcgatcctgtgaaatctgacggttttgacccctcacttagcggctcttgacaaaccgggtcgcccgatggatttcgcccacaaagcgccaggttgccacgcgaccggcttgtgcaatctgacgcttactaagcattgttccacgtggaacatttcggcccagaacgcacgacgatgccttctgcgagatcgcagatcgcgacaggaaggccgctcctacgggattgcccctccatctcacccgcgccctgttttgtggaataggtggcagggaatgcagccactcttcgcagcagcgtgagggagacgatagatggaggcagggaggcaagggtccgcgctcgcggtgcgggcgcagcggcggcgcggggttgacgcagcggtctgtgccggcctcttcctcatctctctgctcgcttacctccgcacgatgcggccgacgttcggttggggggattcgagcgagctgatcacggccgcctactaccttggggtgggccactcgcctggctatccgacctggctgctgctggcctatccgttcagccacttgcccttcggcgatgtcgccttccgcgtgaacttcatgaccgtgctggtgggtgcggtgggggtggcgttgctctatctgctctactccaagatcagcgggagccggcccgcggccgtcatcgcggccctgacctttgccctttccgccaccttctgggatcagacgacggaggccgaggtctacacgctgcacgtctgcctcgccgcgacgatactgctgattctgctggcgtggcgaagcacaggtgttgatcgccggctctacctgctcgcgtgggtgatcggaatcagcctcggcaatcacgcgctgacggccttgatgatccccgcgatcctatacttcgtgtgggcggagaaggggctgcggttcttcacgcgaaggcgcctcctcacctgcgcggggttcttcgtgcttgggctgtcgatctacgtgtatgagccgattcgggccctggacaacccgccgccccacatcaacaacccgcacaacctgatcgagatgtgggcgcagctcaccgcgccgggcgcccggcaggcgat

SEQ ID NO: 90 - DNA, 14121 bp, synthetic construct
  misc_feature 1..14121: note = Synthetic
  misc_feature 1..9257: note = n is a, c, g, or t
  source 1..14121: mol_type = other DNA
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggccaaagccttgtcaaggcgagaagtcaagcgtatttggagtggagcatcgggctcctactctccggtaaaagggcggtgtgctacagcgcaaggtggatgactgcccgcatcgatagggtttcactctccggtaaaagggcggtgtgctacagcgcggagaagcatgcgctcgacacgccgcgagtttcactctccggtaaaagggcggtgtgctacagctcggcgggtacgccagagccgcgtcagcgagtttcactctccggtaaaagggcggtgtgctacagcgctaaggacgagccagccgagtggtatctgtttcactctccggtaaaagggcggtgtgctacagcagagcaacgtcgcggtcgtgcacgtgagcgtttcactctccggtaaaagggcggtgtgctacagcgcggtgtgcaacgtgccgcggctgttcgtcgtttcactctccggtaaaagggcggtgtgctacagcagagcgaggctgactgagttcggggaagcagccgaaatttgaggttgcctggcctcttttgattgtcggagagtgaaaaaagctcagccaagggagaccccgcgggaaaccgtcaggggccaccgttaggaggcaagtttggggaataggtaggggtaaccctaagtgcaacctggggtgcgccttcagctccaggctctgcagggtccggcccagaggactaacgccctaacgtgaagtcgagggagagattaaggtggtcgtgaggccacaaggcaagctggaccatattcctatccctaaacctgagcgaggaggcattacaattcggtccgagaacgtgctgggaattgacttcgggccggagcacgtggggctggccttggtgcggcgggagccggccggggagcaggtgctctacgcggcttccatcaccttgcgcgacctgtccccggtgatgaaggagcgccgcgctctcaggcggcagcggcgctctgagtcatggtaccgccagcccagggtcccacagcggggcgggggcagcgcgcggggagccggggcccaggaagatgagcaggccgtcgagggtgtgccggaagaggaggaggatcgaagtcgtgcgcggtccgctcccgagtaccggcgggcgcagggatgcaataagcccaagcgaaagtgcaagtatgttgaccctaagaccggcgaggtctgcggggccaacacccctcgcaaggagaaggttcgcgatctgctgctgtgggacatctgccagcacctgccggtggaacccgagcagcgccttgccatcctcagctacgtcaatcaggtcaatattgtccgcccggaagtgctggcgtgccttgccctggaagagcgggccttgctggaaaaccatcgagctctggcccgcgcttcgaagagcaagcctctcccccagcttctctgcgaactgaagatcaagaaacagttacaatcccagattctggcgatcgccagcggagaccccgaacgcaaagccgccgacctcaaggggcggatgcccttctgccgcaagcattttctccttcaccacgaacagaccaggattcccaagccctccgcctggcttccgcccagtatccggtgtcggcacgccgacctggagagggtctgccgggaggaggtcgccccccgctggccggtccaccggatcaggctggagcgggcgcagttcgacctgcaggccattcagcgagatccccaggggcggggtaaggactgggaccccgaggagtggcagcgaggtccttgttggggccggcgtaatatctactcggcgaagcggcatgagcagggtaatcgctgcgcctattgcggaaaaaaccccaagaaagagaaccgattagagctcgagcacgttaaaccgggtggcggcaatacttgggataacctggtgctggcctgccgtaagtgcaaccaacgcaaagggaaggctgacgccccgggtgccggtcttgagttttccgttgaccccgataccggagtgagtctggctcccaggggattgggagagtccgtggtggcccggtacatgacccagaccgaccagggataccgggagctggtggcccgcctgcagcaattgttccccgacgcccagatcgagtaccgctacggctatcagacggatcatattcgtaaacggtggatcggctcggcccagtttgcggagaccgctttgtcactcggctacaaacagtcgccgccgcggccgaagaaacgccgaaagcagtggaccgaattggcgcatctgaagcgcaaacccaggcgacacagcgatcccctcaaaagtcatgtgatggacgcggtcgccatcgctagtgccctagagctcgactctccgccgcagctttgcccggcggagaagattatccttcgcccttctcgacgccagctcttcgacaccaaccccctccagcgcggaagtgacgacaagttttaccagcgggtgaagatttgcggcacccagggcgggctggccttcgacaagctgaagcacgtggttgatgacagcaagcgggcgattctggagcgagtgcgcgaccggctgatcgagcaggctaaggtgatcgagcagcctaagggcaacaaagaatccccgcccagcgccttcaccccggatgctgcccagctgatccccttcacgtctgttcgcttggccaaacgagacgcctccaagaccaacacccggaggttaaagggcgggcactggtacaaggttgccggtgggcccaattgggccaccgtcgtctatcggcttggcgtccgtgaacaggtaatcgtgattcgcaacccagcagtgttccccgacgattcagcggaactgccgaaaggcgctcaggtgctcttttccttccgaaagggagagttggtttcctttgagcaggatgggcaaacaacgcgcgcccgaatcaccaagaacaacagcaacggcactctaaccgtcgaacgcctcgacgacggccgggaagtgacccggtcagctcgctgctttcgccccgtccccctgctagcgcccaacgcctgacgccttgtctgagcacccgccagtgcccctcgcacagctccctccaactgcgcccgcagcatctcctcccgccgggaactcgttgtgctgtaactcccaagggtgaacgatgttgtaacagcaagagtgaacggtccagatcgcttgagcaggtgcagcattggcagggctacgccaggaagtgacggtgatcgagcggtttcggatcgtgcaggcggcacactgctccccgatgccagccgggggcggcgagtgtgccaccacgaggccttactgaaaagaatttcaattgccctgcgcttattgcatttttgccccccttttgttaaattagagggggggagccgggcccttattgcacgtatttcacatagctttcggaggttcgagccatcatgacctcagcagaggcaccgtttccgcttgccaggcgaggggggacgtacgtccgccagccgaccggctatcgggctttcatccccaagccgctgccacctgatccgccgctgaacatggatgcggaactgctgaatcggctgtccgccgccgatcaggctctgggccggctggatggcacggccacgctcctgcctgatccggatcggttcgtgtacacctacatccgtaaggaggcagtgctaagttcccaaatcgaggggacgcaggcgtccctggtggatgtcctcgaatatgaggcaagtgcgcccccgcggcggccgctgggcgatgcggcggaagtggtgaactacgttgtcgcaatgaattatggtctggagcggctgcgtgaccttccgctatccctgcgtctgatccgcgagattcatgcacgcctgctagaaggtgtgcgcggcagcgagtggacgccaggagagtttcgccgctcacagaactgggttggggcgcctggggggctgctcgccgacgctgcctacatcccgccccccgttcacgaaatgaacaaggcgctgggtgacctggaactcttcttgcacgacgagaccccagtcccaccgctggtgaaatgcgcccttgtccacagccagtttgaaaccattcaccccttccttgacggaaacggccggatgggccggcttctcatgactttcctgctatgccaacaagggattctctccaagcctctcctttatctcagctatcacttcaagcggcgacgggcggactactacgagcggctgcaagccgttagggatgaaggtgattgggaaggctgggtgaggttcttcctgcagggggtggcggaggtatccgcccaagcgacggataccgccaggcgaatcttggccttgcacgaacagcaccgcggcctcatccaggcgcgaatgagaacggccaatgcgttgcgcctgttggagcttctccttaagcaccccgttatttcgattacggaggccgccagtagcctggagctgacctatggtggcgtgaagcgcctcatgtccgaactcggaaagctagggttgcttacggagataaccggcagcgagcggttccgcctctatgcctacgagccctacctcgccattctcagcgaaggcaccgagccggagtcctccgcctcgcctggcgcccggtgacccggcgggcggcgcgcgcccctgtatcccgccctgcggcgcgaggcaggctgatttcggcccccgggggaaagcgctaatccccctacggcgccgcctcctccatcaccgcgatgtgcgcgccgcgggtgatgccgaaggggacgaagctgtagcggtcgcgccacacgtcgtcggcgctgcgcgggtcctcgcgccactgctcgccgccgaggaa

SEQ ID NO: 91 - DNA, 15259 bp, synthetic construct
  misc_feature 1..15259: note = Synthetic
  source 1..15259: mol_type = other DNA
cacccaggtgaccagcaccagcatcagcgccaggcccaggccgaccaggagggccctccgattctgccagatccgcttcatgccgtcagggactgcggtcagggccgtctcagtggctcccgtacagcgtctcttgcatcatcgtctgtcaccatgatgcaagagacgctgtaatgcaagacccccctagttgcttccatagtttgccgagggcaaccttttcaaccggactggtttgtgtgcctccccggcgcgagcagaccgggcgagaccgccccccggccgccgcccctccccggcagagcgaggccgggagcgggcccctctcccgggccctggccggcccggtcgggcgagccggtgggccggagaaatcgggtcccgggcccttgactctggtgggctggtgtgctagaatcgcccggtttggtaacagtggcgtcggaggtggagctcacggcggacggttccacaactgcgtagcccctgttggcgctaggcgacacggcctcccgcaacatcactgcaatcatcccaggcttggcctctcccgcccacgaggggcgcctgtcccagaggcagcgactcaaagtggtgccgccggccgaggatgggacccgcgagacggacaactggtcgagcgtcgtgaagcgcagggcctgaattcagttcatctgtcatctcttgtgacagcttcacggcgactcgggccaaccgtccggtggacgaggtccgaccccggcccggccggtggagttcgctgactctgttcgcggcaggcggcgcggacgcggaggggaggtgatcactcgaggtgcttcccgtgttgggcccaggcgcgcgcccagcctcggcgcgcccccgggagctgagtagggatcttgctgttgatgtgcgaccctgtcaaggaggcgaggcatgaagaagtgggcagtaccactgttggtctgtttcgggctggcgttacttgccgggacgccgctcttcgcgaccgacgtggccttctggaccgagaccctggacgggcctgctgccccgacggggtggacggcactcggggactggcagttcggaaagccgaccggcgtcactggggaccccaagactggccataccggcaacaacgtgtatggctacaacctcactggtccctacggcccgaacatcgcgccgccccgctatctgaccactacggcgatcaagtgcaccggcaagtacgcagtgaagctccagttctggcggtggttggttgtccaggacgcggactacgaccaggccaacctccaggtgtccaacaacaacaccacctggaccaacgtctgggtcaacagcaaggacgcggatcacgtggacacctcctggacgctggtcacctacgacatctccagcgtcgccgacaacaaggccaccgtctacctccgctgggggatggcctctcagtcgaacaagccctacacctacggcgggtggaacattgacgatctctccctgttggccgctggaccgaccgcgatctactcctggaacctgaccggggcggagcccgcgggctgggtgcgtgacccgcacgccccggcgaacgcgcagcccccggccgctggtcctggctggcagttcggaccggccgcggtgggcaccagcggtcagaacataggcaccccgccggtgctcaccggcgctgacccggccgcggacgccgacggcgtggccggcgggaatgtctacggctaccggattggcgccaactactacaagggcatgagccgaaccgagtacctcacctcccccaagctggactgcacggggcacaccggtacggaggtgcggttcatgcgctggttggcggtcgaggacgccgcctgggatcgcgcctgcatccaggccaccaataacaacgcccaggtcaccatcttcaaggacgacttcgaggccgccaccatcaccggctggaccttcagcgggctgcccgccaccggccccaccatctggaccggagccgggaaccggaacgacaagcagagcgtgaagttcgtgcagcagcagaagatggcacgaaccatcgacctcaccgactactacgcccccctcagcttgacgttctggatggccgccgacaagctcgaggccggcgacaaggtggtggcggagtactcgctcgatggcggcaccacttggcctgacatggtgacactcacggccaacaccgccttcgcgcagtacaccgttgacctggcggcgctcagcccactggtcgagaacaaggccaacttcatggtgcgctttgggatcgagggcaccgcgcccgacaccgatgttgacgaggcctacctggacgacgtggtggtcaagggtgtcaagtgggtcacccggtggtccaacccgaagggcccggtgggctctccggttgacatcttcgacaccaagtggacccaggtgagcgtccccataggcgcggtggccgacggcgaggatgccgtctacatccgcttcggcatgggcccgtcagacgccttcgcgatggccacggagttcggtgggtggagcctcgacaacatccagatcgtcgagggctcccgcgactgggaagtcgcctccaccagcgcgccgcgagccctcctctgggaaaccagcgggacagtgccagttgccgtgggcgcgaggaacgacggcaccgccacctggacctcggactacaagctggtcgaggtgatcgggccgaccgagccggtgaaccgctggaacatcgtgagcaaggcggtgaccggcaccgtggcccctggcgcgacctttaacttcagcgccgccgccctggctccgcccctcacctccatccagtacaagaccccttggcacgtcacctggccggctgacgcggagaagagcaagctcgagtgcaacttcaacatggccaactccgccggcttcttcctgagccggacgttgacgggcgagatcatctacgccaagaacggcgtggtcactcgccgcttccccgacattctccccgggaccgacggcgcctgggccgacttctacactgaggaactcctgggccgcgtcccctacatcgtgatgggcttcccgagcccgatctacccgaacggggtctacggcccgctggtcgtagtgcagcgcgacgccatcgcggtctacatccagcgcgccgcgaacatcccgaaggcggcttaccaggggctgttccgcgatgtgccgtctggcttctgggccgccttggagatcgaggcctgcgccagctccacgccggccatcgtccaggggtacccggacttcacctatcggccgacggacatcatcccccgagacgcgatggcgaagctgatcacgctgggcgtcatcgtgtctggcaacgggctgatcgtcaccgtgccgccgtatcccaccacgcagccgttctcggatgtgtacgtggttgacgatccgaccaagaccccgccgatcgtcaagaacccgttcgccgcctacatcctggccttgaagaacgcggcggtcgtggagggctatccggatggcacctaccggccgagcgtgaccatcacccgcgacttgctcgccgcctacgtctggcgggcgttcatccgcaacccggccaccgcggtggtgctgggcggcccggcggtgaccaagatcaacccgaatcccgcggtcacctcctgggtcggctatccgagcaccgctatggcgcagggtgaggaccagaactacgcctacgcggtgttcgacgccgcccgcatgggcgcggcgatgctgatgaacggcacctgggacgtgaagttcgagctgcgcaacctgaccaccccgacggtcccggctccggccggccgcacgggcctggtgaaggtgcccacggcgaccttcaacgcggcgatcgcaactgcgcgggcgactggtgatccctacttcaccacctactggccaatcccgactggcctccagggtcggttcgtcctggtaaccagtgtgggcaatgtctccggcaccatgactgaggcgctgcgcaagcctgcctacaccgtggtgaaccggatcttctacgacgacttcgaggccggcattgatcccagctaccaggtgctgggtctgccctctggcggcccgctctggtgggacaaggatcccaagaacggcacccactccctggagttcaccggaacccagaagctcgccaggtcagttgacaccaccggcttctacaacctcagcctcgtcgtctggctgggcggcaccaagcttacgagcaccgaccacctcgtggttgagtggtccaaggacgcaggcctcacctggaccaccgccgtggacctcaccaaccacgcagggccggacaccaagctcaccaagtacacggctgccctgccggcagcggctgagaacaacccgaacttccgcctgaggttcggcatggacgccggcaccgacgtgaccaagaagggctacgtggacgatctggagatccggggtagctagagctggccgcccgagcggacagctcggctagctggctcacggactggaccgtagcggaccggcccggcgctcgccgggccggtccgcgctcctcccgcagagcggggagaagcgatccctcgctgggaggtcgagagagcgctgagctggctgcgtgagccgcgttgctctgccccggcgagaaatggaatagatgacgggggccatcgagcggcccccggggtctggtacaggttcgggcctgggccgggcgcgcccctctcgctccgagctggcgggcgcggccggggagccctgcgggcgccagccatgcgcgcctgtgccatccgctcaaggaggcgcggtatgccgagaacgaagcacttgtgcgtcacagcgctggtggccttgtgtatgagcgtgaccgccagcgcagtgctcgcggcggacagttggaaggtgctcggcagcgagttccccatccaggtcgagtgggatgagtcggccaatgtctgggttgacacgcagaacaccggcaccaccacctgggactccagctacgggctcctctctgtcaccggggtcacggtctcagccattcccactgatcgctgggggctgaagctggtccccatcgtgggcatcacggtggcgccgatggcgacccacaagttcgagttcgcggtcttggcgccgccgttcaccaccctgaagtacttgcccccggtgacgcccaccgagtccggcgtgggggactatctggacgccaacttcatcctggcccacccggtcactcccaccccgaccctggtcaccaccgacaccgcgctcaaccaggcggtgatcagccgcttcccggacatccagcccgggaccctgggatactgggcccgctttgaggtggaggagctctccggcagagctccctacgtggtcctcgggttcctcgatggaacctacggaccccgcctcccggtccagcgcgatgccatggccgtcttcatgtgccgcactctgaagctgccaacggggccctaccagggcaagttccgcgacatcgcctccaacttctgggcctgcaaggagatcgaggccctggccagcaccgacattgtggaggggttcccggacgggacctacgggccgtacctggtggtggaccggggtacgatggcggtgttcgtggcccgcggcatggttggcggcgagtcgctggtgccgcccgggccgctccagcccagcttccctgacgtgccccccgtcttctgggcctacgaccacatcgagtatgcggtgagcgaggatgtagtcaagggctatctggacggcacctacaggccgctcactgccgtggagcgcgaccagatggcggtcttcctctggcgcgccttcatcatgccgaccggcgtcccagtggcgctggccggcccggacaccacctcggcgggcgacccggccaccttgccctacctcggctggtcctccgatgggcaggaccctgacttcgcctacgtggccttcgatgccgttcggctggacaccaacctcgtcttccccaagacccccagcggcacctgggatgtcaccttcgagctccgccccggggatagccccaccgccgcagccagccacaccatctccttctacgcggccgacatcaccaaggccaggaacgcggcgatgaccacgggtgacccctacctggtgctctcctgggatctgcgccccctctctctgcctgcgggcacctatcacctggtggtgatggccggagatgagaagggcgtgatgcgactggtccccatgtcaggcacccgtcaagggcatgtgagcttcagctagtgtgccgtctcagaagtgcggttacagtatgaagtgcaatccccaagctgctccgagacggcacacgggcgctcacggctccgacggctgcccacgatccgcgcggcagatatgcaggggtgcagcctcactctaaaggtatttcggcgacagcgcactagtctggcgcatggcaggctgctggcgtggcgcagcgccggtgaccggccggtgacgctgatgcgctgagggagcagccaaccccagcgccacggaaatcagggcgcccgcttccaccgcgggcgccctgccattccctgcgggaggagcggacccggcagaagcgaacaggccaccccatgagcggcgggccggccatccccatcctgctctaccacaagatcggcgccccgccccgcggcgcccgcctcccgggccagtatgtctccccggccctcttccgccgccacctcgactacttgcagcggcacggctatcgcgccatctcgctgctcgacatcgtccaccaggaccgcgacctcccgcgccggccggtggtgatcaccttcgacgatggctaccagtgtcttcaccgtcacgcctttcccgcgctggcccagcgaggctggaccgccaccatcttcctggtggcgggggcgctcggaggtgtcagtgtgtgggagcgagccgccggcggtgctgccgagcccttgctcggtattccggagatcagggagatgcgaagcgcggggctggagttcggctcccacaccctgacccacccgcgcctgaccgcgctcaccgaggcggaggcggcgcgcgagatcggcgcctcgcgatctagcctggccgaggccctgggcgagccgtgtcgctccttcgcctacccctacggtgactgggaccaccgggtgcgcgatctggtggcgagcgcgggctacgaggcggcctgtaccacggtgcggctggcggcccgccgagaggacgatcccttctccctcccgcgcatcaatattcgccgctacaacctcgtgccgcggttcggctacaagctctggcgggcccaacgagcccgggcgtgatggagcccctgcgcctcctccagtacatcaccccctcccagatcggcggggcggaggtgcacgtcgccaccctcgcggaaaagctgcgcgagcgcggccacgacgtgaccgtgatctgccctcgtgggcggcccctggtccccgagctggtggccagggggctgccggtgcgcgcgccccgcagcactggcaagctcgatcccgtgaccctgggccgcctctcctactggctgcggcgagaccgcatccaggtgatccacacccacctgtctaccgccagcttgctcggcagcctggctggtcgcctggcaggcgtgccctcgcttgccactgtccacggcctcaacacccgcacctgcttcaactactcccgtgccatcatcgcggtctcgaacgcggtcaagcagcacctggtcgcgcaggggatgcccgccgacctgatcaccgtggtccacaacggcgttgatctgcgcgccctctcccggccggacgccagcgcctcggtgcgcgctgagtgggggctaccggagggcgcgccgctgctgatcacggtgggccgcctggtccccaccaaggggcaccgcgatctcctccaggccctctccattctggcgagagacccccgctggcaggagctgcggctgctcgtcgtcggcgccgggcccctgctgctccccctccagcgggaggccgagcagatgaacctggccgggagggcggtgttctgtggcttccgccgggacgtcccgcctttcctccaggcggccgacatcttcgtgcttccctcggtccaggagggcctgtccctgtccgctctggaggcgatggccctgggcaagccagtggttgcttgccgcgtcggtgggaccacggaggtggtggtggatggagagaccgggctgctggtggccccgggccggccggccgagttagcccgcgctctggagcggctgctcgcccatcccgaggaagcgcgggcaatgggggcggcgggccgccgccgcgcccagcaggccttcgacctggagcagatggtcaccaagatcgaggccatctaccaccggctcacctctcgctcactcatgtgatcctgagtcagccgcaggcacacgaaagctcccgcccttggttgtgagttgggcagcttccttgacgcccgacctccgcggcggctatactcgaccgggtgggagcgcagcgtccacagagggcttgcccacctcacggagggctggcccgcccttggaggggtgtccgagctggcctaaggagcgcgactggaaatcgcgcagggggccagaagctccctcgcgggttcgaatcccgccccctccgccgcgcctatggccgcggtagcacctccggcccgtaacacgtcccctttcccgccctggccaccgtgcaggcctggcagtggggcttgaaatgcgcctgtagtgtgctataatacgctcgcccgcaaagcaagggatcgtgctgtgctccgcgctgagaagccccagtgccttgcgggagggggaggccatggcgcggcaggccgccgtcgaatctcagtcgctgcggccgcaagtgcgccgctcccgctgtgtcggttagtcagtctgggctgacacttccgtgtcggccccgagcaccttgacaactcgggagggcgacagagccgccagcgccgggcgcgaaccgccagcattcaaaccgaggtttgctgtttcgccctcgcgctggtggacacggtgggcttgtcacgcatgacgataagggtatagtcgtttcgccctcgcgctggtggacacggtggatggatgaactctaccgactcacgactgctgagtttcgccctcgcgctggtggacacggtgctgctatcccgtcgcccatgtcggccgttgtcgtttcgccctcgcgctggtggacacggtgggatgcgaaccccgcccagcttcgccccttgcgtttcgccctcgcgctggtggacacggcgtctgacctgcggacgcagatttacgatcagtagtttcgccctcgcgctggtggacacggctgctgccccttgacccacttggcgaccgtggcagtttcgccctcgcgctggtggacacggcgcgccttgcggcgggcgggattcagattggagggtttcgccctcgcgctggtggacacggtggagggagctggggcgggcccagagcccagagagtttcgccctcgcgctggtggacagggcggcgcggaggtcagcggcgagagtcgccggtcagcgcgagagaggcgacctgcggacgcaatgatgaccagcgctgaagggcgaaaacagcccagccaagactcgccgcggacaggcctggtagcacaggactgagccggtgtggcgagcgcgggaaaccggcggggaaactcggccggctaccgtcaggaggcacgtttggggaacaggtaggggcaaccctgagtgcaacctggggtgcaccttcagctccaggctctgcaaggctcggcccagagggactaacgccctaatccgcttctggcggcttgtccgcctccggcggaaagggagagaaaggcggtcgtgaggccgcaaggcaagccgagccatatccctgtcctcaaacttgggcgggaaggacaacttgtgagtacgagtgcaggcgagtgtgtgctcggcctggacttcgggccgaagcacgctgggctcgcggtggtcctgcggggtccctcggccgacgaagtggtgttcgccggggaggtgcgtttgcgcgccctgaaggccttacgctctgaccggaaaaccccactctccgagcggaagaccatactcggcgtccggcgggccttgcgccgcagtcgccgcagccgcaagcgctaccgccagccgaagattccccagcgcggcggcggggccaccacagataccccggagaacaccagtgccgccaggggccgccctcccgagtaccgtcgcgccaccggcctcaacacaggccgaagacgctgcaagttcacggaccccaccaccggcgaagtctgcgccgtgaacaccccccgcaagaccaacgtgcgcgacctgctgctctggaacatctgccgtcaccttcccgtgtctcttgcagagcgcgccgcctttgtgtcctacgtcaaccagcgcaacctccaacagggtgaagtgctggacgcgcttccggcagcggaccaggccgcgcttcaggccgtctttgctcagcagcgcaagcccaagcaggaaccccttgccgcgcgaatgcgtcgcctgggagttgaccgccacctgcgctcacagatcacggacattgtgggcactacctcacgccggcccctcagcggcaggctctcgttctgtcggcagcacttcctccgccaccacgagcagacccgagtagcccgtccgagcgtgtggcttcctactaccatagagatgaagcacgcggatgtcctccgcgtgtgcggccaagagatcgcgcccaggtggcaggtgcgccgaatcgtgctggagcgcgcgggcttcgaccttcagctcctgcggcagcaagtatccttggagtggagagtggaggactggcagcgagggccccgctggggctaccggaataccttcgaggcgaagaagcaggaccaaggcaaccgctgcgcctactgcgggaagaagccgtcacgcgagaaccgatttgagctggagcatgtggcccctggcggcggcgattcctgggagaacctggtgctcagttgccgcgcctgcaaccagcgcaaagggagtcgaagtcccgccgaggccggaatgctcttctgggcggacaccgaaaccggagagaccctggccccgctatctctcggcctgtcacgcgtggcccgctacatgacccagactgaccagggctggcgcaggctggaggcttcgctgcggaggctgttcccaggtgcagaggtggagtacacttgggggtatcagactagcttctaccgcaaccgctggggcctgcccaagaagcactacgctgacgccgcggtcattgccagctctcaccaactggagcgcaagctcgcgcttcccgagcagccgaagcgcttcgcgcccgcgccaggcggcaagcggctcttcgacacgaacccgctcgcgcgcgaacccgacggccacttcacccagcggcagaagctggtgagcgagcagggagggctgacgttcgccgaagtcccacgcgtggagaacccgcggaagcggaagctactccaggccgcagccgacaaggcaatagccgaggccgccgccaaaggagagaagccgccggcggcgttcactgcggcgatgcttgctggccttccgttcaactcagtccgcctcaccaagcccgacgcgcaggagcgcaatacccgacagctagggcagcagtggttcaaagtcgcggggggccccaacgtcgccaccatcctctacgaacacaacggcaaccaggccaccctcgtcaaacggaaccccgctatcttccgcgctgacccaggcctgcccagaggggcgcgcgttcttgcggtctaccgcaaaggtgacttcgtggagtgcagcgacggcctgggccgggtgacgaagaaccacagcaacggcactctaactgtcgaactggtggatacaggaaaggcggtgacgcggcaggccaagtcgttccggccggcgcgcaagccgccgcgaggatagcaaagagtccgtagggccggagcggccacccttttcccccgtggggaagctaccaaagcggcccaaccacccctcctatgcgaggcgggccctgcaggcagagaggaggcaacggcgatgaaggccgaccagtcggggttcatccccggaagcgacatcatattctgggttggcgggaccgaagggtacgaagggttgcgcctctgcccgcgcgacggacgcatcctagtccgtggtaaggaggtggccagagacgaggaggtcgtccgcgcagtggccgacgaactgcgacggctggccggcgcgctttgagtctttcgttgcggcgtccttgccacctcgtcggggccctcggacccctctacgccatcccctccaacctcttctccgtcacctccccccgcagtggttccccggcgaagaagcggcgaaggtcctccaccgcgaaggcggccatctcccagtagcggctcggcaccggaccgcccacgtgcggggtgagcagcacgttgggcaagttgcgcagcgggttgtcggccgcgggcggctcgggagctgtgacatccagcccggcccacagccggccacttctcagctcctcgatcagcgcctcctcatccaccagcgcgccgcgcgccgcgttcacgatcaccgagccatccgggatcagcttcagccgctctcggctgatcatgccgatggtgtcggaccgcaccgccgcgaagaggcagatgatcggacaattgcgcagcagatcctccagctccaccagcttgatcccctcggcggcggcccgcccgcggtcgccgtgcttgctgtaggcccacagctcgcacccgaagggccggatcatccgcacgaactcccaggcgatcatcccgagcccgaccattccgacccgctgctcgatcaacgtctcggggttgaggtcactgtacgtcccccaccagagatcagagcctttcatctcctcgcgaaatcgcgagatgcgccgcaggcaggagatggccaggcacagggtcagctcggccacatagcgagacatcatcggcgtggcgcagctcatcgtcaggccgcggcggaagaactcccgcgccggatcggggagaaggaagtggacgcttcccgcggcgtgggacacgatgcgcagccgcggcgccgcgtcgagcacctcgacgctgagttgcggcgagccccagccggtgatcagcccctcgcagtcccccaggtgcgcgctcagctcctgctgtgtgagccgcccctccttgcggttgtagaccggctcggcgaaagcgaccagcgcctcccgcaccttgccggggaagagctggtcctggagctttccgcctggcgccacgaacactctcggcctggtcactgcccgctgcctccgggatgggatgggggatgccggactcacctggtcccgagcgcggcctccgggacgaggccgcgccaagctctcagttctcgctgccgtcgcttctgctgctgctcttcccggcgcttgctcaaccaggtttcaaacgcttccctggtgtcgaagtggaggctgtgctccgaccgctccgggtactcgcaggagccgtagtcgtactcccgacagacctccggccggctctcataggtcaggcacaagttgtcactggtcaggtacttgcagggcgtgtggacctccaggtgccagcgccgcccctccacgtagacgctggtgctctcgtgcgcgaggaaccagctcacctcgtcgaagtcccatttccgcctgggcggcggaagcaccacggtgatgtagcggcagcagcggctcccgcactcgtatcggcacacccggtccgcctccgagatggtgtggttggcgctcatcttccgccccctggcctcgcgctcaagacggccttggtttcgtcatgctgcgccagatgcctgttcccgaagcacctgaccgcggccccgctggcgggcctagtgtgccgtctcagaagtgccgttgcagtatgaagtgcgatccccaagctgctccgagacggcacacgggcgctcacggctccgacggctgcccggaatccgcgcggcagatacgcaggggcgcaccgtcactgtagaagtatctgggcgacagcacaccagtgtgccatctcagaatcccccggttttgtggaatgaggcctttgccgttgacaagcgaataggcgacgacacggcagatgcgctaggctctgggtctacagcttccgccccggtctcccccagatgggcagagacgccggcggaggcaatcaccaggctgccgaagatgccaagctcgtgaggagccatgggggctcctgcgggcgggacctctccggcagcctgtttcttttgagcggtcgccagcgagaaccgaataagccactaccggaaaggaggtagagtgttgcggacactgcactggtcgcatggggagcttcccccgccccgcgcactgcccgcgcgaccagtgcgccatgtcccaccgctggaaccttgcctgttccctggtcgcccgaggcgctccgacactgaccctcctgtgctcgccagggccgcccggcccgacgagccgcccctgcgggcgacccacaactgaactcccgcggtgccaggggcttctccggccgccaaccgcccctcaccagcgggcgatgtctaacacggcgcaactccctcccgcgccatgtctggcccggcgtccgtccccggcgccgggccagatccttgtgttccgggcatgtgcccgttcccggaagtgagggtcctctaacgaatgtcgcccaaagaagtaatgggcgacattcgtcagaaagctacagagtctcgtgaatcatggtgagagaccatgattcaagagactccccaggagagcgtctggcgcccttctgagagattctcttgcatcaggggtcttatcctgatgcaagagaatctgtagagcgcatttcataaccctcaatcgcctggctggcccgcacctgtgctggcgtgaaatgcgcccacgcaagcctgccgcccttgctgggctgtttcatgacctctttcggaggttatgaaacagcctctacagagtctcttgaatcatggtgagagaccatgattcaagagactccccaggagagcgtctggcgcccttctgagagattctcttgcatcaggggtcttaccctgatgcaagagaatc

SEQ ID NO: 92 - DNA, 13454 bp, synthetic construct
  misc_feature 1..13454: note = Synthetic
  misc_feature 1..8579: note = n is a, c, g, or t
  source 1..13454: mol_type = other DNA
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcacaggacaggagacccacgatggcaacgctgagcgacatcacggcgcttgagtcggccgtgcgggcagccgtggcgcagacgacgatatcggacatccacacgcacctcttcccaccctctcacggccggctgctgctgtggggcgtcgacgagctgttgacgtaccactatctggtggccgaacttttcaccgtggccccgcgcgacctgacccttcagaagttctggaagttggacaagtcccgccaggcagagctggtctgggagcatgtgttcctgcgtcacggggcgctgagcgaggccgccaggggcgtcatcacggccctctcggccttgggactggacgtggccgggcgcgatcttgcgggcatccgccggtggttcgccgcccagaatgtcgagggctatctcaagaaggtctttgagcttgccaagctggactacgcagtgatgactaacaaccccttcatcgccgaggaggccggctattggaggcgggacctgccgcgaccttactacatgaaggcggcgttgcggatcgacacgctgatcctggactggccagccgccgcaagggcaatgaagtccgccgggtacaggaccgccggggcaacggggaccagcttcacccaggcccgcaagttcctcaccgattgggccaagaccatgcagccggtctacatggcggcgtcgctgccgccggagttcgcctatccctggcggtcgcgaagcgggctggtgatggacaaggtcgtcctcccggccgccaaagagctggggttgccgattgccatgatgatcggggtccgcaagaaggtcaatccagccttgggcgacgggggcgacggggtgggtgtcgccgatccgacggccgtgcagcacctctgccagagacacccggacgtcaagttcatcgtcacgatgctgtctcgggtcaaccagcaggagctgtgcgtgctggggcggaagttctccaacctgcacgtggagggctgctggtggttctgcaacaatcccagcatcgtcgaggagatcacgcggatgcgcctggagctgctcgggacggccttcaccgcccagcacagcgacgcacgcgtgctggaccagctcatctacaagtggtcgcacatgcggaccgtgctcgccaacgtgctggtggacaaataccgcgaccagttccttgccggctggcgggccagcgaagaagaaatccgccgcgacgtccgctctctcctgggcggatccttcgaggaattctgcaagaagtagcaggcgcttggcgcggcggggtgtacgcatgctcgttgcttggaagggtggtgggggaccgacccgccaccctgggtcttctgatccggaatccctattgccaaccccaaccgggacaagtaaactctgtggtctggggtgcgattcatggagaacgtcctcgggatagaccttggtgggaaagcggtcgggctggcggtagtcgagcagccctccaaccgcgtccagtggtgcgggaccgtaagactctcggacaagatcaaggacctctacgaccttcggcgaaccctccgccgcgccaggcgaagccgggtgcgttatcgaaagcccaaggtcgccgaaagaggaggcggggccggggggaaaggcgaggagggggcgacctacttctaccggaaagccaaagggctgaatcagtcgctgcggacaaagtgcaagtacgtcgatccccagacgggagaagtctgtggaaagaacacgccccagatggccaatgtccgccacctcctcctggaggacatactcggctttgcgccctttgccccggtgggggaggactgcaagcaggccatccgagacatcctggcctcgcaggacggcgacgcgcgacgccgggaacgcctcgagaacgtcctggggctgatcgatctgtccgaatacctcgaggagcagatcaaggacatcatcttcgggaagggcgacgggcgtgcccagttctgccgctcgcacatcctgggccaccactcgcagaccgagactcccaagcaggccgcgtggttgccgccatcgctgaagctcaagcaggatttcatcctcaaggtcatccgcgagcggggcaagccttgccgcatcgatcgaataataatcgagcgggcgaacttcgacctccagaagatcgcggcgggggtgatcgaagacccgcgcgagtaccagcaagggtatcgctacggatttcgcaatacccgtgcggcgctgatgcaggaatacggggcgaggtgttgttattgcggtaagagcgtggcggggcagaaatggcacatcgaccacgtcgatccgcgcaggacgggcgagatcaaccgctgggacaacctcgccatagcctgtgaaaagtgcaatcacagcaaaggcgggaagacccccaaggacgcgggcatgcgcttcgcggtggtgacggagaaggtcgctgggcgcaagatacgccgctccctggccccgaagcccgtcgagggcacccgcattcacaagtacatgacccagaccgaccagggcataaacatgctaaagaacgctctgagggaaatcttccccgctgctcccatcgaggagaccttcggctacgagaccgccgcctggcgggacctgtgggggctggagaagggcaaggaaaaaggcgagcaccacaacgatgccatcgtcatcgcttcagcccgtgtcccggaagggattcccaaggcagacgcgcagcccgaggcaatatcgcagaccgttggtgggaagcgcctcttcgatctcaacccggtctcccgctcgcccaacgggcgttactaccagagaacgccggttttggccgaatccggggggataactcccaggcaactccccgccgtggtggaccagcgcaagcggaagctcctggcacgcgagttcgaacgctacgggatcgaggggaacaagaaactcccggaccgggcccgggagcgcctgcccttcaagagcgtcttgctgctcaagcgggactgcgcggacgggaatgtgcgccggatgagaaccggtcattccttcaaggtctccaatgccggcggaaccagggtcaacgaagcggtaatcgtctacgagaaccttttggggaaactatcctgttacccgctcaagaacccccgggccttcgggcctacgagaccaccggatgatttcaagagggaattgttccgattccgtgcaggcgacagaatcgttgacctcaacggaaggtccctcggggaggttgtggagtttgggagcgacggcaggttgacaacagacaaaggacataacacaatagcacacaggtgcagacgggggagttaggcaaaaagccttccctgctcccccgtgcggtggatcgatagaccgaagggtcttggagctttttggcaagtcaataggtgagtgccctgcgagcctcgcgagcatgggattgatgcctgtacgacaggacggacacgttcttctacgatttcggcctcgcgagcgtgggattgattaccgtatggcatatcaggaacaggagcaggaacatttcgggctcgcgagcatgggattgatggcccaagcgggttgcggcgtgaggcagtgcggatttcggcctcgcgagcatgggattgatgccctcgctgagtgtttccgtctcggcatcttgcaatttcggcctcgcgagcatgggattgatgccctcgctgagtgtttccgtctcggcatcttgcaatttcggcctcgcgagcatgggattgatggcgtctcgcctgcggtcctagtctcatgcacaatttcggcctcgcgagcatgggattgattgactccctgtcgaatccagcgcaagcggacgaaatttcggcctcgcgagcatgggattgatgttacagtgcgtcccagtggtcccactgactgcatttcggcctcgcgagcatgggattgatgggtgaagcaaacaggatcaaggcatttgagtacatttcggcctcgcgagcatgggattgatactgaggggtagtgcctcgaaggtgggcagaaccccacccattgtgggccaggcaaaagaagtctcaaccgcgaactaccctggaattcccgtgttcctcgaggtcgaaagcagccacagcgaaggccccgcaagggcgcctgccggagaatccaacgaaaggcggaatccggccacgagctacgtttgcagggaagcctaagacctatgccgggatgtagtgactcgtctacccagccccggcctcttggagtctcggcccggaagatcaacgccctccccccggttcgccggggaagggagagaaaggtcctcgtgaggggacatcgcgctgggcgaccacgcgacgcccgccctcgggcgggtgagacaagtcgagacacgtgcgacctgcaaacattggctggggatagacgaggattgtttttcctcccatatgctcccgcggggcactcacctgttgctgtgattatgtaaacggggaatggaactcgttggtctatcttcgaaccgcggggccgcgggtgctacatcagcgcggtggagaagtagcgttcggcgcggtcgggcaggacggtggcgatgttgccggcgattcgcccggccagttggcgggccgcccagacgttggcgccgctggatatgcccacgagcaggccgtaatcgcgacctagctggcgggtggtctcgatggcgtcctcgtctgacacctcgaccacctcgtcgatcatcttgacgtccaggatggccgggacgaacccgtcgccgattccctggatctggtgcagccccggctcgtggcccagcagggccgagacgttcttgggttccaccgcgacgatccgcgccgcgggcctgtgctccc

SEQ ID NO: 93 - DNA, 2637 bp, synthetic construct
  misc_feature 1..2637: note = Synthetic
  source 1..2637: mol_type = other DNA
atccagggttacgctatccattgattttggttacaagaatatcggccttgctttggtgagggaccatgagggaatcaataccccactgttcgcagggaccctcctctacgacccctttcaactcagcacaaaggttggaccaagggcggaactccgcaggggacgccgaaccagaaaaacaaagaaacaccgtctaaatcttttaaaaaagaaattgttcgatacaaatcttacagaaggagcggttcaagaacttattactttttgtaggcggaggggttatagctctctgtttgatgtaaaaggcccccttaagaccgagaaagttggctcaaaagaggaaatcgtttttcgttttactagagaagagttttttgaggcattagaaaaacagatagatagattggtccctgatgaaaaaaggagattggtcctcggcttatgcgaaaacatccttaaccgagccggtgaaccttctaaagaaatccggccattaagaattaacaatcgaggagcctctcggtgtgcctgggatgggtgtgagaatgtgacgccacgccgggacaatgctcttcgggaccccctgtcccaattcattcatacagtttttgctgtgagtctcagaagtgatacagccctccaacaggaagtcgcaagaatgttagaccgtatcgcagaattgggaaagcggctccgccatcgaggaggccctaatccagacaaagagcgtaaagttctaaaggcagaaatcagcgaggaacttaaactgttaaagaagttgtatggcctcagcactgatttgactgaagaggatgctaccccctgggcaaggattcggcggaacataatgaacctgatagaacagaccggaggccgtaatcgattctgccgttcccatagttctcaatatgtcaattacttcatggagggaaaaccgataccctttaaggcaaccttgagcgaaagggatttagtgtcccgccgtgaagaaatcctcttccaaaagatatggcgttatattgaagcaagaatccttccccgtgcccctgatggaattgaccgggtgattgttgagcgaacagccatcgacctattaggaggaagtcgcaaacagcgccaaggcataatgaacaaagaagcccttgaagaaatgtatcaatatgggcctcgatacggattcagcgatgatcttgaaatgctgagggaggaatttggtggactctgtgtctattgcggcaagcaaaatgccgaacttcttgaaagagaccatcttctgcctcagtccaaatttttctttgacagttatctgaataaagttccggcttgcgcaccctgcaatcgaacccttaaacaagccgcctcacctggggaggcagcactcaggattcacgaagacgcatacgatgcctattctaaatatttgggttctaaatttagggataaacctcctcatctgtttcataccatcaagaaaggtgtcctcaatctcatgcgagagccaactcgcgtttggaaagttgagcggtatctcaacctcatcgccaatcagtttgcccaagtggtggggacccagcgagggcctcgcccccttgctcgttatctcagcggtaagatttataaacggtttggtgagaagccccagattggctttgtcaatgggaggcatactgctatttggcggagggcggcctatccagagtttgacaaattcagggataaggccgagggtggaattatcaatcatgctctggatgcactcctgatggcttgtgacttgcctgatttgaccgcacttgaagcaaggaatttacagcctggtctcatgtcttggtgggtggatagggtcaggaaagcagccccaccggaagggccggatggaataccggtaatgcctgaaccccggttcgcaacagacggttttgaggaagttcatcctgggaattatattaaaactgacttggcaaagatgaactggaaccataaagacactcaggtccaacgccagggtgcctatggctggtcaaaaaaagaagacctacctgtacagcgggttacggctgctagtctcgctgacgaacttcgtaaggccgataaaaaaacgtctccagaatcgaggagggtcgaggtcgataaaattgtaggtgtgattgttcacccgcaacttcaccaaaccctgaagggggcaaatattggagacaccccaacgttaagcacagcagaggcacttacactctggttgcgaaaaacaatccggggtaacctaagcaaagcccggttttcctctcatcccgcagaccaatcaaggtctaaaatacttcaggatttcatcaacgggcagtctaatgtaatccctgcggttattggagtccaaagattccaacgctctctgaaatccaatattgacttaaatcgagttgacccccaaagcggtcgccttatccaccgatacgtcgctgacccggcaaatgtggcttacatagtagcctaccgacgagacaatggtaaagtcaaacgagacaggccgctgacgcttgagtggcgtcagagcggagccgtcatccctggtgtcaaattgtttggagatgtccccgaaggtccattgaaaggtcgttcattgggtgaaaaagccatcgaaca

SEQ ID NO: 94 - DNA, 12532 bp, synthetic construct
  misc_feature 1..12532: note = Synthetic
  source 1..12532: mol_type = other DNA
tcgagaagaccggaaagatcaaaataggtttcagggaggattctatcccctttgctttcatagacccgaaggtgggaaagcagataggtttctccgtggacatggcccagctccttgctgaaaacctctccaaacactttggcaagaagatcgagattgagccggttaccattaccacaaagacccgtatccccatgatcatcaacggaactattgatgtggagatgggatccacgacatacactcaggaacgggaagatgtggtggacttcagcctgattttcttcttctccgagacggcctttcttgtacccaagaatagtcccatcaagaccaaaaaagatctgaccggtaaacggctggggggcgctcagggaacgacgaacctcaaagccatggaggatcaagccaaggccggagagtacaaaccaaaagagatcgtcaccgttgagggacatgcccagggattcctcagtctcaaaaccggtaaaatcgatgcctacgccacagatcgaagccttctgatgggtcttgcttccaaagacgaaaatccgggtgcctggcggacaacggatttcgccatcgcctatgagccttacgggtatctgatgcgagagggcaattcgaatttcagggatttcgtcaacaataccatcctttcggcgatcaagactggtaaattctatgagctttatgacaagtggatgggacccaaaggacagaccccgattcccatgtctcaggcttacaaagactacctgaaactcattgtctaccccatgaaggacgattggtggaagaagcaataagaacagtcatcccaagataagaggccggagcgttcaggatgtttgcctcagtcatatgaggagacgccggcttcgacagactcttatgctgtgggtgctccccgccttccccggggtattggaagaggtttgattgtcaattgtaagaggaataataaggaatgggactggcatataagtttgactggagcgtgctgtggcgcgagccttacggagaatggatgctgcaggggatatggctgactttgcagatggggtttctcgcatggatcattgctctttttctgggaatctttgtcggcacgatgcgtgctgcgccatggaagctgttgcgcctggtgagcacgatctacgtggaaatctttcggaatgttcccttccttgtccagctcttcttctggttctatgccggtccaatgatcttcggcaagacccttcagttcaagatcaacgccatctccgggttgaattattacgttgcagttgtcggcctggggctttacacggcaagccgcgtggctgagcacgtgagggccggatttgcctccatcggccaaggtcaataccaggcagctctatccacaggcatgagtcagtggcagatgtactggcacatcatgattccccatgcgctgcgccttatccttccgccccttacgacggaattcctcacgatcttcaagaactcttcggtggccatgaccatcggcgtggccgagaccactttcatgagctacaagatcgattcggatacattccacgggttggaggctacgacgggagccatgtttgtctaccttgtcctgggaatggcggtggtaaagaccatgagttacattgagacaaaattccggattcatggactggtaggcagataatatgtttgatgcgatcatcaacaacctttcctaccttttgaagggattcctgacaaaccttgaattggcgatctgcgctcttgcaggaggaatcttcttgggtatcttggtaggtctggggcggatctccaagaaccgttgggtgtatcacagtgtaaccctttacgtgaactttatccgaaacatccccctcatcctggttatcttctggttctactttatcatgcccatcctagtcggtaagcccctgaaccctttcctctctgcggccatttcctttgtggtctttgaagccacctatttcggagagattttcagggcaggctttcagtccatcagccgtgatctggtaagcgctgcttactcaacagctcttacttacactcagacagctcgttacatcctcgtgcccatcgccatccggcggatgctccccagcatgatcactcaaagcatcatcacctttcaggataccagcctggcttatgtcatcggacttcaggagttagttcgtagaaccaccatcgtcgatagtatggaggtgcgctccatccagctttacagcttcgttgccgcgcttttctttgtcatctgttttgtcggatctcgcatcagccgttactatgagatgaagagtcgagaggccaatatcctatgatagaaatcaagaacgtgagcaagtggtacggtgacttccaagtcctgagcggcatcaacgagaccatcgaccggggccaaaccgtagtcatctgtggccccagcggttccggaaagagtacgctccttcggtgcatcaacggcctggagtcttaccagaagggtgagatcaccgtggagggtatctcattaagcgaccccaaaacgaacctttacaaggtgcgccggaagatcggcatggtctttcagaagttcgagctttacccccatatgacggtcctgcacaacattaccctggctcccatgaaggtactgaaaaagtcgaagcaagaagctgaaaagagggctattgcacttcttgaacgtgtaggcattcctgaaaaagcgaaggaatacccggcgaacctctccggcgggcagcagcagcgggtggctattgcccgcagcctggctatggatccgagctacatgctctttgatgaaccgacctctgctttggatcctgaaatgatcaaggaggtgctcgatgtcatgatcgacctggccaaagaagggatgaccatgatcgtggtcacccacgagatgggctttgcccgcgaagtggccgatgagatcatctttattgatgaaggcaaaatcgtcgaaaggggaacggacgagagtttttttgcaaaccccaagagcgaacgcacaaaggcattcctcagtcagatcctggtctgaggcccggctgaaaggggaggggaagttggcagagaagatcatcggcatactcggcggcatggggccggaggcaaccttggactgttttgaaaaaatcataaggaataccccggccgtaaaggatcaagaccatctgcgggtcattattgattcaaactccaaggcgcctgaccgaacagaagccattctcggtaaaggggcttctctactgccgctgttggttcaaggatgcaggacgctgcaacaggcgggcgccgatttcatcatcatgccctgtgtgtcggctcatttttaccaagaggagatgcgacaacagataacccttccctttgtctctatttttgacgttgtggccgagaccatttcccatgatcatccggaaatcaaagtggtggggttgctgggtaccaccggtacggttcgcagcggtctttttcaaaaaagactgggagaggatggaatcgagaccattgtttgcgaggataagatccaggaacgggtcatggccgccatctacgatgttaagagcagtcaggcggatcggccgcgagaggcaattacggatgatcttgttgctgccgcccaaagcctcatcttccggggagccctggggattgtggccggctgcacagagattcctcttgctttgagtcaacgcgacctgtctgttccctattttgacgtcctttttcttcttgcccgtgcggccatccgcctggccggaaaagagcctctttctctgcgataaaggccgtgtcttttcatgagttcaataaaaagcaaccgaatcacgcgcagccggctggaagggcaaaagcagggttgcggctgtgttcaatcttgagaggacaggatgtctatgactgtcgaacaactggagtgagccttaagttaagtgtatgaatgacaatatggtgatgggcgaagtgcctgtcttatgatatagaagaatgcaaggaggaaaaatggacctcagtcgttttccacgtcgacgttataccgaaggacaaacacctattgaaaaactttcccgcttttccaaacaactggacggccccacgatctacatgaaaagggatgatcttttgggacttgcggcagggggcaacaagacccgcaagctggagtttgtggttgcagatgccatcacaaaaggcgctgatacgctcatcacctgtggagcagtccagtccaaccactgccgcctgactcttgccgcagccgtcaaggaggggctcaagtgcaggctgattctggaagaacgggtgcctaagagctacaatcttcaggccagcggcaacaacttcctgtttcaattgatgggagtggagaaaatcaaggtcgtgccgggcggttcggatatgatgaaagagatgcagactgaggccgatgaagtggcagctgccggccgcaaagcatatatcatccccgggggagcttccaatagcctcggcgctttgggatatgtggcctgtgctgaggagatcttgaatcagatctttgaaaagggcctgaggatccaccgcgtggtctgtgccagcggcagtgcagggacccatgccggcctcgttacgggtttttgcggtaccaacagcaatatcccggtggtcggaatcaacgtcagccgcaccaaggaagctcaggaagaactcgtctacgggttggtccagaaaaccgcggagcatgtcggtgtcgagggaaagatccccagggaagcggtgctctgtttcggggattacgttggagcgggatactccctccccacccccgacatgaccgaggcggttaaactgctggcacgtaccgaagcgatcctgctggatccggtctataccggcaagaccatggctggaatgatcgaccttgtccgcaaggggtatttcaaaaaggacgaaaacatccttttcgtccacaccggcggatcaccggccctttatgcttatagggaaacctttctgagcggagtttaaacccgacctcttcctagaccaaaggggtcattggtaacgatgcacttcgattattcagattctcagatttcattcgatgattccttctatgccgatcccgattacccgatcgattcctatctaagctgatggggctattgatcttattcgggcggataggggttggtctgtcctttataagggttgattccccgctcctgggggcgaaatccctgtttgcgatggtttcgaatccattcgatggtacaacggaaaaggacaaggtactacattctttataaagaccgtgaattacgatatcgaaaggggtacaatatctgctatctatcatctgtttccgatacgttaaaaaagtcacgatctgattttcatatattcatttgggacgtgatttctaccagtaatcctctgcccaagatgttatcgttgagcgatgacttgtaggtgcaaagcgttaaaattgagcatccttttattaccaccaacatcccctcaatggtcagtgccggaatttagaggcaaacacccttccaattcttattgacaccccattccgtaaagaatacaatcaaatcgaaatataggctatttgtcattaacctctaaccattgggtgggtatatgatctggagatgaatttagaccccatttctgaagtaggaatatggtttttgttgtttttacatctataattccttaaaggatatggagacaaaggtaacactatccatcgatttcggttccaagaacatcggccttgccttggtaagaaaccaggaaggagtaaacattcctttgttcgctggcactctcctatatgatccctatcaactcagcacaaaggtagggccaagggcagaacttcgcagagggcgccggaccagaaagacaaagagacaccgcctaactcttttaaagaaaaagctacttgcaataaatcttcccaacgaaacaattcagcaacttattaccttttgcaggcgccgagggtattcttccctttttgatgaacctcagaaaatcgaccaagaagcaaaggactcaaaagaggaaatcgtttttcgtttcagtcgggaggaattttttagagcattagaaaaacagatagaattgttggtccctcaagaaaaaagtgggaaagttctcgcttcatgtgaggacgtccttaaccgtgctggtgacccttccaaggaagtccgaccattaagatttaataatcggggagcctcccgatgtgcctgggatggatgcggaaatgttccgccgcgccgggataatgctcttcgggaccccctgtcccaatttgttcatacggtatttgccgtaagtctcagaggcgatgcaaccctccaggatgaggtcgcaagaatgttggaccgtatcgcggttttgggaaaacgcctccgtcatcgcaaaggccctgatccagataaagagcgcaaggctctcaaggcagagatcagcgatggactcaaactgttaaaaaaactgtatggcctaaaccctgatttgacagaggaggcggctactccctgggcgaaaattcggaagaatataacgaacctgatagaacagactggagggcgaaatcggttctgccgttaccatagttctcaatatgtgacccacttcatggaagggaaaccgatacccttcaaggcgactttgaccgaaagggacttggtgtctcgccgagaagaaatccttttccaaaagatgtggcgttatatcgaggcgagaattcttcctcttgtccccgatggcattgaccgagtgattgtagagcgaaccgccatcgaccttctggggggaagccgaaaacagcgccaaggcattatgaacaaagaagcccttgaggaaatgtatcagcatgggcctcgatacggattcgggaatgaccttgaaatgctgagggctgaattcgatggtctgtgtgcgtattgtggcaggccaaatgccgaattggttgaaagagaccatcttctgcctcagtccaaatttttcttcgacagctacctaaatatagttcctgcctgcccatcttgcaatcgggacttaaaacaagccgcctcaccaggaggggcttcgctcaggattaacgaacaggcatacgacgcctattctaagtatgtggcttctaagtttgcgaataaacctccccatttgtttcataacatcaagaagggtatcctcaatcttatgcgtgagcctggtcgcgtctgggagggggagcgaattctcaacattatcgccaaccagtttgcccaggtggttgggacccaacgagggcctcgacctcttgcccgttacctcagcgggaagatttataaacggtttggggagaagccccaaattggctttatcaatggaagacacaccgctctctggcgaaaggctgcttaccctgaattcgataagtttagggagaaaaaagagggtggtgttatcaaccacgccttggatgcactcctgatggcttgccacttgccggacctgacttctcttgaaacgaggaacttacagcccggtttgatgcattggtgggttgacaaggtgagaaaggctgccccacctaaaggcccagatggaatccctgggatacccgaaccacgctttgccgtggctggttttgaaaaggttcaccctggaaactatgtagaggtcgatttggcaaagatgaattggaatcacaaagattctcatattcaacgccagggtgattatggttggtcgaaaagggatgatcttcctgtccaacgtgtgacagctgcaagcatcgcggaagaacttcgtaagaccgataaagcggctactccagaatcgaggagtaccgaggtcgagaaaatcgtgaatgtgattgtccatcctcggctttatcaaacgctggagagagcaagtattggcgacagcccaggggcaagcacagcagaagcactcaaaatctggctgcgaaaagcaatcaaagggaatttatacaaatcacagttttcatcccatccagcagaccaacgcagggctaaaatgttccaggattttattaatgggcaaactgatgtgattccagcggtcattggagttcaaagattgcaacgctcgctgaaatccaatattgatctaaatcgagttgaccctaaaagcggtcgccttgtgcatagatatgtcgctgacccggcaaatgtggcttacatagtagcctatcgaggaagtaatggtaatgtcaaacgagatagaccgctaacgcttgaatggcggcagagcggagccttaatccctggtgtcaaattgtttggagatgttccggaagggccattaagaggccgcgcattgggtgaaaaagcgattgaccagaaagaatggaagaatgctttgcatcaatacctgaccagggcagggatagctgaatataactttgtgtctcaagggaatgtagtggtttatgaagatggcagcgaattgtatatcaggaacttttctggtagctatggttttagaaagtcctggtttaaaggaataaaagcggtccgaccttcgccgctgaccgagcgtttgattccgaacgcaaaaatttagaaaatttcggtttagttctttgacaattggatagcgtgttcgggttcaagctgaaaagagcatctgtccggaagggccactccgggttagggcagacccggctcttgggcctccttggtcttttggctctggaggaaacctttcggcgcgtcgaaagacaagatgtgagcctatttaaaattcatctatttgaactactcagtaagccaccctgaacttctcaactccgttgagacgaggcagatctcctttgggctcaaaatcttgagtttgtttcagccaccctgaacttctcaactccgttgagacaggcagaggagggatagacgatggatattgacacagtttcagccaccctgaacttctcaactccgttgagacataaggtttttaatgccattactaaagcatacttagtttcagccaccctgaacttctcaactccgttgagacctaagaatacagtctcctcggccaagcaggtgatgtttcagccaccctgaacttctcaactccgttgagactctatgactacgttgaattcagaacgggctattagtttcagccaccctgaacttctcaactccgttgagacaagcaaccttaacggacgcaaagggaacataaaaagtttcagccaccctgaacttctcaactccgttgagaccagttaggcgaaccatgggaactcatacgattaggtttcagccaccctgaacttctcaactccgttgagacgacaaataatattacatcagctttcttacctcaagtttcagccaccctgaacttctcaactccgttgagactgctatccaaaattcatgagtttttaagcgtagatggaggagtgtttctgcgaaccttcccacacacttctaaagatttatcgcattcattcgtcagcataggcttaagaggttgatgttacttcttaatttaaaattgcgaacctacggggcttctttggtcactaacagttcgcacaccaatgcagttattttgtcttaaacattgttatcttcttttttccttagagtaaaggcatcaaaattaacaataagggactggcaggaccacgctcaacactcggtggtctacactggtagaggacggtagaaggtttacagggaggcaagagaaaatagaaagagatagccacggggcagaagactatttagccttgtgcaaggaaaccgtagagagggggtagaggacgcataagatttatgggaacttcaggccaacttagaaaagtagaaggccgactaataaaggatttggagaaaactactattcccttcttgcagttggcgaaaaaatacggagtgagcaagcaagccatttcccgttttctccaccggaaggggatcaagaggcccaagagagagcacacagaaaagtgttcaatctgtcagcgactgatcgggatcgccaagaagcctcacagcgactttatatcctctcaaacgatcaaaaaacagttaagaattggaaaggtaaaatggatttaccatatcggcattcttagaaggaaggggcttgtctctcagaagttcgggagactgcgttccagaaaggcggagcaggcttatcagatttattttaagaaaagacttcccgtcaggaccatagggaggcaagcgggacttaaaaatttctattcgatcattagacagcataagggtttaggttgggatgttcctgcccctctttttacctatgactcaaacgatcgaagtaaggccaagttaaagatgactaaaaaaaagagaaggggtagctatgtataaaaaacgcaggttaggctcagaccctttggagtggataagggacacagagaatacgtggaggattggggagacctggagaaacagatatggcagtagaacttgatgataaacaagtcgtctcctttgaagaactcctgatgtcccaggtagtctgataagagtcccttactatgttttaataattggagtttaagatggattttaatactgaattagaaaacctaaagttacaaatgaggatcgaaccagaaaagctttctctctccttggagaatttcatcagggaatatatggaaagattagaaagggaaggtgtgatcttgggcctgagtgggggaattgactcagcagtggttgcagcattgtgtaaaggggcagttggttcagggaaaaccttggccctcattatgcccgagaaggactcagaagaagaacacgtcaaagatgctttgaattttgctaaagagttaagcattgaaacaaaattgattgacataacaccctatcttaaaagattaggtgtgtataaattagctccgctcaataaaattcctttcttggggaaattaagggcacccttgatcaaaagagcctatcaattctataagcgaaggacgggggagacccctttttctgccagcattctcggcttcagggataaagaatttagcaattttcttaagaaaaggaatgcctattatcggtcaaaacataggctaagaatgctattgctttatctttacggagaacttgagaacaaattggtagttggagccgctaataagagcgaatatcagattggctactttgtaaaacatggatgtgatgatgcaaccgatataatgcctcttttgaacttatataaaactcaggtgagagaccttgctctatatttaaaaatccctcctaagattattgaaaaacctccctcacctgatatccttccagggattaatgatgaagaagccatagggatttcttatgaaagattggatttgatcttattggctttagaaaaaggattggactctcctgaaacagctaagtttttgaaaataggggaaaaagaatacgagtatgcaaaaactttaatgcagaagtcggagcacatgcgaaaaatttatgcacctaaagggaacatctaaatacaacgctgagaatctgctcataatccataacaagaaattggcttcgctgtacatcaagaattggcaagaccatgctcaacattcggaggtctacaggggaagagggaagtaaaaagattataaattcttgaagggtgttttgagtttggaagtgatgataaaatacttcgcccctgaacttttatgctgaagcgagaattaatcgagaatttgtgtgatcaaacaatcgaaagagaagaacgggaaaagctcaaggctctccttttacaaatagcagaaaaggttcttcttcaaatagtgaccataaaggtagatcacgaatccgggttgagaagaacaaatggagaacgcctaaacgctgcatatgatcctcagacgaagaccataactatatatgcaatgccatttgatcccaagtatgcgtgctatctatatcatgaaattggacactgtattttttatgaatttcaagatgttgcccatgctgccaaaattgaatgccaaaaaggggagagaaataaacttgaattgtatcattttagctctttgaaaaaggttatctaatcccccttcatccccctttttcaaaagggggaaatattttctcctccctttggtaaagggaggtggggagggattttaaaagatttatttcaaaccgctaaattgataccttgaattatgtttctacgatggtaatgttgaagcatgggcttcggaattttgtgcaaatggatttgaattgttcaaatctgaactgtgtttgaatgagagagaacgttatcaagcaatgatagaatattttgagagaaatgaattttgaaaataatataggagaagtcgtatggcaaccgccctcgatcccaaacaaatcgtttcctttgaagaactcttgatgtactaagttgtgcaacaagaagccctcaccaggttgctcgtggaaaaaggaataattaacaaggaggagtttttggagatggtgag

SEQ ID NO: 95 - DNA, 22142 bp, synthetic construct
  misc_feature 1..22142: note = Synthetic
  source 1..22142: mol_type = other DNA
gcaacaaatagtcgggcgtttgcgtgcaaaagagcaagaaatcgatcgtgccgcgatcgatgtcgtattcagcaaagaggcgttcggccgccgccacgcccaggtcggaggcacattggtcgggtgcggcgatgtgccgttggcggacgcccgtcttcgcatagatcaggggcatgtcccacttgggaaactgtgccccaaggaagtcgttgtcctcgaccttctcgggcaaatagatggcaatcggcccgatcgcggcgaactgcatcgctaccaacctccacccagaaccccgggccacttctctattttaccatccaccccactaggtagatacaggccggccccgacaatgtcagtgccgcacgagcggcccgctccctagccgtcacactttactccccttccaaagatacaagatttgtgggcccatgaatagagcggaagtacggggcggctgatggattgcgagtggggaaatgccggccaaacggctgccgaatcggccgaaccgttcccccggcaccagtcgaaactcgctctaacaggccaggaaagcaggttgcgaacgcatcgttgtaggacgcgtgaaatgccccgcgcggagcgggacgtgggtggtgtgttgcaggtgccctacgaaattctgccaccagagagggatgttggtgattctaagtcgactccggccattttatcttttctattttgccaagccattgtcaccgcggacgggcctcgtggaacggctttccggcgtcgtagagcgtaacccgtgcctgcagcgcgtcggccagccgctggtcgtgttgctgcacggcaagctcgagggcctggcgggccgtggccgaagcctcgtcgaatcgtccagcttcggcgtatgcggcagccaaggcatccagaatatctggccgctgcctgccaacaagctcgttcgcccgctgggcgcgctcgatcgcctctgcgccgtttcgcagcgacgccaggggacacgttgcctggagccacgctaagtttttctgggcgtccgcgtcgttgggctgcgttaccgctactttcttaaagtggttcaacgcttcatcaaaccgaccctgggaggccaggacggtgccaagattgttgtgggccgccgggctattgggatcgatttcgagggccttccgataaagggatacggcctcgtcgaggtggccgcagtgcgccaaggtgtacccgaggttaacgtgcgtcgtggcattgtgagggtcgcttttcagggcaccgcgcaaatgaaacacagcgtcgtcgaggtggccctgcgcggccaggatggaaccgaggttgttatgagccccggcgttgtcgggcacgatttccagggttttgcgataatgcgcgatcgcttcgtcggcttgtccctgctggccgagaacgaccgcaaggttgtagtgggccagccagcaaacgggattttcggcaatcgtccgcctgcacgccgtttccaggttggaaaatgcctggctttgccgccaggtcagggccgccagcacggccagcagcatgaggcagaacaggtagccggcgcgccgggaaaggagccgccagcggtccaacaggattaccagtccggcggagacaagggtcatgatgcccatgctggccaggtattggtaatgattcgccacgaatgagtagcgcgacgtgtagaggttgaagaaacccagtgcgggaaagagcgtgccgacgaagaatagccatgccgccaacggtgcgcgggcccagcggcggatcgcccacaacacgacggttaacccgctggcggccagcacgaaaacgtattgccaccatcgtgtagaatcgatttgccagcgggggtagacgatggtcaggttcacgggccagagcagtttcccgagatagaaccagacggcccgtccggcgacgagaaaccgctcgatcaacggcaaatcgtatcctggcccgacgcaccggttcagatggatctcccaccacacggttatcattcctaagcctgcccccatgagaaacagcggcaccagcggcagcacgtccgttttccacgacaagcgtccccgctgccaccaaaagatgaccagcaacgctccgggcagggtggcggtgacggtcttgctcaacaaggcgagcaggaacaacagcagcgcgcagaggtaaggcgacttccttcgcgtctggtcaaaacggaaataggcgagcatagcccccagataaaacacgcccgaaagggtgttcttctgctcgctgatccaggccaccgattctgcgtttatcggatgcagggcaaacagcgccgcggccagatacgcgccggggatgcccaaccggtgcaacaccaatgccagcaaaacggcgcacgttgcgtgcagcaggatgttccacaggtggtagccgataggcgcttcgccccacaggcgatgttcgaaccagaaagcgctgtgcagcacggggtagtactgcaccgtggacgtcacgtcataccaaatgcgcgccaatccgcgccacgattgcagatcggcgtgcgtaacatggtcggcatcgtcccagatgaaggtgccccgccaagcgggctgatacacgaagagaaccgtcaccaccagggccaccacggggagccactggcgaggggccagggaccgagcggctgccatgaaccgcattggcgccgagcgtcccaacgcgatgttgtcaggtgcgggcggcgcatccagagattttttgggcatgggtccttacgctcgcggcccgcggccgtgcggccaggctgtcttcgtgttcccgatgacaacaacgctccgcctccggcgatactttcagtctgacacgggcgggccacgaaggcaagcgacgtttgccgccccgcatggtacgcgccgagacggccacaagtcgttacggtaacccgtgttccgaacccgttaggtcggccggcgggcctctctcttcgaggccggggttttcgcggtggggctatccatcaacgcgggcaagcggtcgctacccaccgccgctgccaccggtttaactgtaccggccagatggctgccgaatcggctgaaccattcgcgtgccattggtcgaaactctctctagaagagccaacaaaagacggcggccactggtcgcaccgtggacgacaactaccgccagggaggggacgttgccattcttcagccgactgcgactgttacatcttttccatttctccaagccctccggcgatcgcccactttaccgggcaatttatcgccactgcgcacaaaaaatcgtggagttgaatgtcggcgatggccgccgggcacagcgaatgatcgaggtcgcccatcggcgtgcgtcggctccgggcaacgttcactatgtcggcctggacccgtttgaaggccgttccgaggccagtgcgccgagccgttccctaaaggaggttcaccaactgctgcggggcaccggcgcccgcgtacagcttgtgcccggcaatctctccgacaccttgatccggttggccaattcgctggggaaggtggacgtgttgattgtgcccgccgaactggactctcccgcgtcggctcgcctatggttcttcgtaccccgcatgcttcaccagcagtcgcaggtattcgtcgagcaggtttcgaaaaaaggcgagttggtgctggctattaagccgcgcgaggagatcgaccgcttggcggctgcgggcagtgctcgccgcgccgcgtaacaggcgttctgtggtaggccgcacctccggggcggcagtgcaacttccgccccaactaagctaagctccaactgccgccccgaccatgttcctgacagccgaaggcggtcgtgccgcagcacgtcccccctcattcgacgggtggtgttgaccgcgcgcgaaaagcggattacagtaaatcttaatgtttgctaagcgggtcattccatgcctcgatgtccatcggggccgggtggttaagggtaccaactttctccatctccgggacgccggagatccggtcgaggtggcggaacgctatgaggccgagggggccgacgaactcgtcttcctcgatattacggccagtcacgagcagcgcgatatcattctcgacgtggttcgccgcaccgccgaggtgatcttcatgccgctgtgcgtgggcggcggcattcgtacgattgacgacatccgcgccctgctcaacgccgggtgcgacaaggtttcgatcaactcggcggcgtgccggaatcccgagttcgtccgccaggccgcccgccgcttcggcagccagtgtatcgtggtgaacatcgaccccaaacgagtcgtcaagaacggaacggaattctgggaggtgcacattaacggcggccggatcggcaccggacgggaggctgtggcttgggcccgcgaagtcgaacagttgggggccggcgagatcgtgctgacctcgatggacgccgacggcaccaaggacggctatgacttggagattacccgggccgtgaccgatgcggtttcgattccggtggtggccagcggtggggcggggtgtccggaacacctggccgacgcgatcctgatcggcggcgccgacgccgccttggccgccagcatttttcactatggccagtacaccattgaagaaaccaaacgcgtgatgcagcggcggggcattcccgtccgcttgatgaaagccgaatcggcgaatccctcgctctccgccccttaaccatggctactgccgaccccacacgtcaacgttttgttgccaaaacgcaagagctggaaatcgacaagcttttccgcgcgctggtcaagctcgagggaagcgacttgcacttgaaagtcggcacggcgccggtggtccgcgtgcacggcacgttgcggccgctgaaccgcgagccgatcgacacggaagagatggtgcggctcatctttcccatgctcgaattgcaagagcggcggaaacgcatcttcgacgaggacggcggggtcgacttcgcccataccctggacttggagggcaagcactggcggtttcgcgtgaacgtgctgcaacagatgggccaggtggggatggtggcgcggcgcgtgaacaacgtcatccccgatttcgagcatctctttctgccgccttcgatggccggtctctgcgaatattcccagggaatggtgctgttggccggcgtgaccggttcgggcaagagcacgacgatcgcctcgatgctcgactggatcaaccaccgttaccgcaagcacattctcaccttggaagaccccatcgagttcacctttaccgacgacaagtgcctgatcaaccagcgcgagatcggcatggacgtgaaggacttcggcaccggcatgaagcacgccgtgcgggaagacccggacgtcatgctggtgggtgaaatgcgtgaccgtgagacgttcgaaacggccattcaggccgcggaaaccggccacttggtgttcggcacgatccacgcctcgacggcccctagcacgatcggccgtatcctcgacctcttcccgcagaacatgcatcccgcgctccgcagtgccatggctttcaacatgaaagccattattgcccaaaagctgctgccctcgatcaagccgggcgtgggccgcgttcccaccaacgagatcatgaccttcaatcccacggtgcgcaagctgctcctcaacggagaggacgagaagctggccgatgccatccgcatcaacaaagatgacggcatgcaggatttcaccatgagcctgcgcgacctggtcgagcgggagatgatcgaccgggccacggcgttcgaggtggctcccaacccggaggcgctcaagatggcgttgaagggcatcatgctcaaagagtcggcgatgttgtaatgggcacggggaagattccggatcgacgatttatggccaccacgtcccgcttgctgctcatcgtcgcgatgctgaccgtagtgctggcggcggtggcgggtacattgtccgccgccgctcccgcccccggggcccctggcgccgcgggcgcccccgcccccctccccgccgacgactgggccaacacgccgctgggaaaagacttccgcgggccgggcttttatctcagttggttgaagattctcgccgcctggttgatcttcctgctctgggtctacaccaccgactgggtcagcacggattgccaggagctgaatctgaattttgcccgctggaactccgtcgtcttcggcagcttcatgctcggattcgtgttcctgtggattgttcccttgttctggatcggcttccccttgttgatcgtcgcctacgtggcgccctttgccacctacgtggtcaagcgcaacaagcaagtcgataatgatcggcaggtgctgacgcgggagcatctgcgccactggctggccgagcagttgggcaaggtcggtatcaagatggccgcggaaaaacgcgatccgcgcgaagcgggcgcggcggtgaagctttcggccgagagcgggcccgacgcggcggtcggcaacgcccgcttgctgcaggcccgccagtcgcccggctggaacgcggcgcggcaaatgttgtccgaggcctttgccggccgcgcatcgtcgctgatgctcgattatacgcaacaaggcgtggtggtgcggacgatggtcgacggggtgtggattgccggcgcggaaaaggagcgcgagcgggccgactccgccctggaatcgctgaagctgatctgcggtctgaatccgcaggatcgccagggccgccaggaggggaactttgtcgcggaacacaagtccgttcgctatggggccagtctcacctcgcaaggcaccgccggcggcgaacgcgtgctgttgcaattcgaagacaagaaggtccgcttctacaccttcgacgagttgggcctgcgcaccaagctgcaagagcaggtcatggagctgctcgccacgcggaaggggctggtgctgttctcggccctgcccaccggcggcctgcgcagcacggtcgacgtggcgttgcagaactgcgaccgcttcgtccgcgagttcgccgccgtggaagccgaggagcatccctatcaaacggtggaaaacgtccccgtcaccacctacaaggaagccgagggccagtcacccgtcgacgtgctgcccagcctgtttcgcaaggagcccaacgtcgtcttggtccgcgacctggtcaacgccgagaccctcggtctgctgtgccagcagatcgccaagaacgagcggctgattatcagttcgatccgcgccaaagacgcggccgaggcgctgctgcgggtgatggccctgggggtgccgccggccgagttcgccgaggccattacgggagtcgtcagccagcggctggtgcgaaaattgtgcgatgcctgcaaagaggccttcccgcccacgccgcaaatgctgcagcagatgggcatccccgccggacgcgtccaggccttttaccgcccgccgcagccgaacccggaacagcccaaggagcagtgccaggtgtgcggagccaccggctattttggccgcaccgcgctgttcgaggtgctcaccgtcggcagcacggtccgcaaggcgctggcggccggggccaagctcgacatcatgcggcacgctgcccgcaaagacggcatgaagaacttccaggaagagggcatcctgctggtggcccgcggcatcacctcgctgcccgagttgacacgcgtcttgaagcaatagtgcggagaatgccatgacctcgatcttcccgctcctgctcgtcctggtcctcttcgcctgcgtggcgatgacgtatgccgagggcatgtggagcaacgcgatccgtttgatcaacgtcgtgacggcggccctcttggccacgaacttcttcgagcccgttacccaactgctggaaggctgggcgccgaaggtcacgtatgtcgccgactttgtggtcctgtggttgctgtttgcggtggcgatggcggtgctgcgtaccttcaccgaccaggtgtcgcgggtgaaagttcgcttcccggaacgggtggaccaggtgggcggcgcgctgttttccctgtgggtgggttgggtgctcgtctgcttcctggtgatgacgctgcacacggcccccttggcccgcaacttcctcttcgacggtttccagcccgaacagcgtatgttcatgggcttggcgccggaccggcagtggctgggattcatgcaacgcatgtcgttgggcacgttttgccgctcggccacccccgagcaatggaagaaacaggagttcgtgttcgatccgcacgccgagttcatgcccaagtacacggcccgccgcgtcatagtgcaggcgaacgtcgccgagcacgatagcatctgcccgcccgagcgctaagtttcggaccccttgacccgatcatgcgtcccagcgtccccgacgtccacatcaccgatccgcacgacgccgacctggcggcctatcgggcgttggccccgcaggccgtggcgggattgattttcggactgttggcccccctggccatggtcgatccgctgctctgggccttgccggcgctgggaacgatcttcagcgtttggggactgcgccgcattcgcagccgcaagggcgaattgattggccgcaagctggcctggcccggcctggtcctttcgcttttattcctcgccctcgcacccgccgatctgctggcttaccgctggatgatccgtagcgaggcccggcaattctcggccctctggttccgctatctcagccaggaggagccgcagaaagcctttcagttgtaccagtcgccgcagtttcgccagccgctggacgatcgcctgtgggactactatcgccacactccgcaacagcgcgacgccctcaacaagttcgtgaaactgccggtggtccgcacgctgctcgccctggggcccaaggcccaggtgcgcttctatcagaccgggggcgaaggccgcgaagacgacaacgattgggtcgatcaatactacgcggcgacctatgaagagcagggcgaacggaagtcgttttttgtgctcgtgcacatgtcgcggcaaaaactcggcaacggccaggccggctggcgcatcctgagcgccgagggcggcgtgcggccggaaggctggtgagatcgccggccgttgcggctgcgaagccggcttcggaccgcggcgcaactataattgggcgtcgaaagtcccgaattgtttagccggcttgcccgccgcgtttttcagcggttcgctatggcaatcggagcgcgggcaggaaataccggctttcggtcgccacacgccgttaccggaaaaaacggcgactcgggggattgacattccattccgcggggactacgttcgcggatgcacatagggcgctctttgacaattcgaacatcaggtggcggttgaaaagagccacggccggtgctcagcacccgaggattggacagtccccggcactgcccggcaggtacagagaagcctgccgagatgagaccggcctatgtggtgagtccatgttttttctttgcgagttgaagcttgctcgaaaacctgattcctcttcacccgttgcgaccccgcaaggcgccgccgtgctaccggcggctcgctccgtttcaatcaacctggttcctcttcacccgttgcgacatggaatccggcaaggacgtccgtcggacgaaaggtttcaatcaacctgattcctcttcacctgttgcgacgttatcgtcgtcgagcgagtggccgacaaggcggcagtttcaatcaacctgattcctcttcacccgttgcgacggcaccctcttaaaacccatagatggggccgtctcgcggcggcgaattcgcgaacctgtgcctttggcgggcgtggagagagttcgacgccagagacgcccatgtgcaatccgttggacgataaggtgttacggaaaacgcgaacctcccagggatttcggcatcgctagaggttcgcgggagggcacgaccgatgtcctgtacccttgcggttgatttcggctcgcgcaacatcggcgttgcgttggtcgagcatgcgccggacgcgcctaaccgcgtcctgtacgcgggcacaatcgttgtcgatgccaagccgctcaactcggcagtgcaaccccgggcgatggcccggcgaatgcgacgcacgcgaaaaacgcacgaacgccgtctgcgccggctggcccaggctctacacggcgtcccgaacgcggaccacgtcgttcgcttttgccgccgacggggttatagctacgagcccgaggaggaaacagacgagggtacgcgagcgttgtcgttctcacgcgcggagttttttgacgcgcttcgccgtgaaatccagcagagcattccaatccagcagcaagatcaggttttgcgggcctgctcgaagcatctaaatgagtctcgacgacgggacgccgaacttcggccggcccgattcgagaaccgcggcccgacgaaatgccaatgggaaggttgccggcgcaacgtaccgcgtgccggcaacgacgccaagggccgcttgcagcaggcgctttatgtgtggacgaaaccggtcttcgacgtttctgaaaacgccggggcgctccggcgttccatcgaccattggatcgcggaattggacgcattggcccgctggtatcgcaagacgcgaacgctcgacgaagcggcagcgaaagaagagcgaaagaagatcgatcggcgaaagaaccacgtgtacaagaacctgcgggagcgggttgggagggaatgcactggggatctgatcgagcagttcaaggaaaactggggcaggacctatagccgaaatcttaccgacattgtacacggtgggcagggaggtcgggtccggtattgccgcgaacactcgctccgattcgttgactacttcctcgccggaaagcaaattcctagccgcgcggaggtcttcgagagcgatcttttcggccgcacccagcagattctttttcgccgtatctggcggttcgtggagtgccgtctgctgccgttggcggacggccatatcgaccgggtggtggtcgagcgcgtggcgttcgacgtgttggcaggcaaagcgaagaaccggcgcgaggtccccgaggataaggcggcggagatgtactggcacggcccccagtatggtttttccagccggctcgagatgttcaagaaggagtttgacggtcggtatgcctactgcggccggcagaacgcgattcacgaagtcgagcacctgctgccccgaagccaattcgcctttgattcgtacctcaacattctgccggcttgcagcacgtgcaattcccaaaagggaccacggacggccttcgccgcacggatgagcgttcatcaagacgcctatcaggcttactcggactacgtcggccggctcaaaactccccatttgttccacacgatcaagaaggggatgctaaagttgctggcgcggtccggcaacggtaacgaggtggagaaggaattggggatgttggccaataacctcgtgacgataaccagcacccaaaagggaccgcgcccgttggcccggtttttggccagcggactcgaaggactaacgcagaagccgtgccacgcaagctggacttccggtcgccacacggccctgtatcattcgatcctgttgccggagtatcgtaaagccgaagagaaagaaaaaggcgacctgattaaccacgctgtggacgcgatcatcctcggctgcgacttgccctcggcgacagcgatcgagaatccgcggtggtacgctcgcgctcaagatcttatagcctggcgggagaaggtacaggaaaacggcccggtcctgacaaatggtcttccccaggtggagccggtcgagttgatgccgttctttgaagatggtttgggcgacggatattccaagatcgacctcagcgcattcaactggaaccgctcgcggcagtctggccacaagcttgatccggtgggcgtgacccagaatgggcagccgatcaagccgagcgtaaccgttcacacccccgtagacgcggcgtctcgccgcgtttttcggcgttatcggggcccattcgctcgcacaaagcggcgagacgccgcttctacggtcgccgacccgtgaacggttacgcgtgagccggcaacggaattgctgcacaatctgtgcgatcccgcacgtcgcagtgaccaaatcgaacgaatcgcgcatccggcccttcgtgccattttgcaggcggatccggagcacgcggcagaacgattcgtgttatggttacagcaatcggtgaaggccgggctggcggcggccggaatgggaaaccatccgtcggaccgggcacgagagcggttcttgaacgccttcgtcaattcttccgttgaaaactatctcaccggagtcgcagagaaacgcagagacatcccgcgcgtgatcggcatccgttgcctgaatgccggggcccccgcgatgttcgacgtgagccggtcggatcgcgccggccggatctaccagcgttacaaggcggatcctcggctaagggccctatacgtcggttatcgtatgcgggacgggaagctggaccgctcccgacctgtactgctgtgtgtcaaccaagtttatgccgtcaccgagcggaccagcagcggcgagacgccgttgaacgtaccagccggaagcgcgctgcacggccgcccgcttggctccggcggcaacttcaagaagtttttggccgactggcagaaagcgttcgatgcgttctgcgatcaagccggtatcgtcaaacgtttccgcctcagccagggatgtgtgatcgaaaagaccgacaatacgcgattccaactgcggaacttcacgcgcgacaagccgtggatgaaagggtcgcctttccgggacatacgccgggtttaccgatcaccgttccgctttctggaagtcggttgcgagtaaggtgaagcgtccaccgcctgacaggcggggcggccacgccgtgcgtgacccaaaattacccgccgcttgttagccgaccttgccgccggccagcatcagacgggccaacgtctgggccagggcgtccaatgcatcgcggttgggcagggtcacggtgagccgttgccggcccgacgagtcttcctccacgcattcgctcagccggctgcgcacctgggccaccagcggctcggcgggcggcggcgtttgatccgccgtgaccagctcaccgaggaagctgaaaaccgcgcccaacatctcgccccccgccgccgccagacgatcgcggtgctcggccagccgctccgtctgaccgtcgacctcctcacgccgcgtaacatcgagaggcgcttcgggcttggcgcccagcaacacttccaagcgccgccgcaactcctcgatcccgctcttcatctcgacctgtcttacgcccgattcggcgtccaaggccgccagcgccaggtcatgtttggccgacagcgtcgccagcaggttctcttcgatcgtctcttcggtcactagcacgtacacttgcaccggctgacgctgacccatgcggtgcgcccggccgatccgctgttcgaggatggcggggttccagggcagatcgacgttgatcaccgtgttggccgcctgcaggttcaaccccgtcgagccggcgttggtggcgatgaacaagcggcaacccgggtcgtcctggaaacggccgaccagttgctggcgcttcttctgcggcaccgagccgtccagccgcacgtactccagcttgcgacgcgcgagcatcggttcgatcaggtcgagcatcgtggtccactcggaaaagagcagtgctttgcggtccggctcggcgaacaacccgtcgatcagttcccccaggtattccagcttgctcgaatagccgggcgcttgcttctcgaccagatacgtgctgtcggccgacatgcggcacatcaacaaggccttttgcagccgcagcaggtccatttcggaaatgtacgccttgcgggcgatcatcgtggcggtgcgcatgtgggcggcgtgcagctcgatctgctcgtcggtgggcggaatgcggacgatttcgctggtccgcggtggcaactgctggagcaccgactcgcgcgtgcggcggagcaagaccggccgcagattctcccgcaactgatccaggtttttgtaccccagcaccttgccgttctcgtccaccacgcgatggcgatggaagaagcggaaggcggggggtagccggcggtcgtcgacaaactgcaccacggagtagagttcatccagccgattctccatcggcgtgccgctgaggaccagcgcgaacggggagcggaggcccttgatgacccgtgccgtcttcgattcccagttcttgatccgctgcccttcgtcgaggatgatcaggtcccaggcgacgcgttcgatggccaggatgtcgcgtagcacctgctcgtaattgcagacggtgaaaaaggagtcgttgtcgtattgccgcgcccgctcggccgcgccgccggtgaccagttgcacggtgcgctcggaaaagcggcgaatctcgttccgccactgcgacttgagcgaggcggggcaaaccaccagcacgcggccggtgccggcctcgcgggccagcagctcggccacgccgacgccctgaatcgtcttgcccaggcccatgtcgtcggccaggatagcccgcccgaccccggcggcgaaggcgatcccgtcgagctgataggggagcaactcgactttcagcagttgtttgcggagcgggtgccgcgccgggtctttgcgaatctcggccatccgctcggacatgtgccgctggaacagccggcgttggatcaactcctcggcgtcaggatacacggtaatattgcggcccaaacgatcgagctgggccatgccgtcgacaagccgccgcacgtcgtcgatcggcttgccggccagcgcgcccagcgcgtcgaccagctcggcagggggacgctccgggagttgcagatggagcgtgacctcttcgccgtagaggacgtggacgaaggcctcgcgattgcgatagggcttgcggcgcgccgccgccggaaaacgctgccggaggcggtgcaacacataaaggatgtgcttgcaggtgccgagggtattggtgcgaaaatcggggcaggagcagtacgactgcccccggtcttcgccgcgcaatgccacgcgataggtcttgcccgacagcgcgctggtgatcgtgtaatcggtccacggccgcgccgaatcggaggacgcgagacgaaacttctcggttcgcgcccgttcctggcggtcgcggagggcctgatcgagcaactcctgctcgttcaagagctccagcggccggcgctcgtcgggcgcggcggccaggccgaggatcgtcttctcctccagaacgagcgaaacggccgcgccgatgtgcgcgcagaggccctcgcaggccgtgcagttgaagcggagccggtttttcgccccggccatggccgtaatggtggccacgacgtcccggccgccggcgcccaccccgcggagcttcaagcgaaacagatcgccgcgaaaatagacgtcgcggtcgacgtcgatgtcgtcgaaagccgccccttgacggatcaactgcgggccggcgggccccaagagctggcaggcccgataatgggtcagccgtgaaaggcggtctttgagggtgagtttgccactgtgtttggtcttcgccgtacgtgtcttggtcttcatgacgggtgctcgctggtcctcgcagtgccgtgtaatcgataaatgacaaccccaagagtggggtttattgtcgatgttggccgcccgtccgtcaaggccggcaaaaccggaacgaacgctgccttggttgcccggcacccccttcgcgcccggcaatattttgctaattttgataacggtgcttaccccttggaaggcaggccccggccgccttgacacccccgagggcggccgatatgcttactagattacgagggccactaagttgtggtaacgtaagattttgaagcgtctcggccgttttggtgggtcgagcggggcgtggagaatatcggcgaagcaagcgaaagcgagagcgaatggatcccaacgaactgctgcggatcgtcgacgcgatccaccgcgataagaacatcgacaaggaaatcgtctttgccggcatcgaggctgccctcgtctcggcggcgaagaagcactatggcgaagaggaagaggtcgttgttcagatcgaccgggccgacggctcgatccgcggctcgcataacggcgtgcccatggaaccgaccgagatgtccgagcggatcggcgcgcagaccgccaagcaggtcatgatccagaaaatccgcgaggcggaacgcgacacgctgttcgccgaatacgaagaactgcgcggacagttggtcaccggcgtcatccagcgctacgagggaggggcagccaccgtcacgctgtcgaacgtcgaggcgattctcccccgcggcgaacagatccccggtgagacgcaccatgccaacgagcgggtgcgggccaccgtgtacgaagtcaagaaggcgggcagccgggtgaaagtcatcctcagccgcaccaagccacagttggtgcagcgcctgttcgagcaggaaatcccggaaatcgccgaaggcgtgattgaaattcgggccatcgcccgcgaacccggctaccgcaccaaggtggcagtcagcagcaccgatcagcgggtcgactgcgtgggggcgtgcgtgggcgtgcgcggcaatcgcatcaagaacatcgtcgatgagttgtccggcgaacgtatcgatatcgtccgtttcagcgaggacatgcaagtgctcatccccaacgccttgcagcccgccgaggtcgaggaagtgatcctctgccagatgctgggccgggcgatcgtgctggtgcaggaggatcagctttcgctggccatcggccggcgggggcagaacgttcgcctggccagcaagctctgcggctgggacatcgaaatcatgacgcgcgaggagctcgacgagcagatcgaaaatgccgtggcgggttattcgtcgttggaaggggtggagtcggacttggccgaacgcctggtcggcgagggttttctctcctatgacgacctgtcggtgatcgagcccgagtcgctgatggaaatgggctcgctcacggccgagcaagtggacgtgatcgtcgggcaggccgagcgcaaggcggccgaggcggaaaaggccgccgccgagcagcgccggcaacaacgcgaacaagaacggttggaggcggccgaggcggcggaagcggccgccacccagtcggcctattacgccgatggcaagccggcggaagtcatcgaacaggccgcggaaaccgcggcctcgcctgctcctgccggcgggccaagcgaaatagcttctgcccccgccagcgagccaaacgaaacagcctctgccccgtcgaccggtacggaaccgcagtcgcctgcctcggcgggcgaggcgggccgtgcggaatccgagtcggcggagcatcccgcggagtcagccgatgacgccgcccagtaacggagcctttgccctagaccgcaatcgcagacagctcgacgccacttttcacagggagcggccctttgcccatccgcatttacgcattagcgaaacaactgaagctcgacagcaaggtgctggtcgacatttgcaccaaggcgggtgtcacgggaaaaggctctgcgctggccagcttgaccgacgaagagatggcaagggtgacggccttcatcgacgggggcaaggcaggcgcggcagcggggcggggcgccccgctgggacatcccgaggcctcgaccgccacggctccgcccgttttccgtcgtgaagactacattgctccgggcggcacgactccctccagaattccggtgcttccttctcggcccgagaggccgccgctagcgaagaagaaagcggaagagacgccgcccgtgccggtggcccccaaggaaacgcagcccaaggaaacgcggcccaaggaaaaagaagccgccgtggcggaaagcaaggagcgggagaaggagaaagcaaaaaaagaggccgagaagcgggaaagggaaaaggaacgcgagaaagagcgggagcgggaccgagggccggcgattaagttggcccccttgccgacgatgtcgcggcccaccgtgcggcccaaagcgagcgagcccgccccgcagaagccggacatccggcttcccaaggacgccatccgcgcgagcaaagcgggtaccaagccgctttccgaacatctccgcaagcatgagcagcggcgcattgccgccgaggccgccaaaggcccgactcacgaacaggcgccggttgcgccagcctccgaaacaccgtcgccggccagccgggagcgtccccgccgcggggtgcgcagcattattccgcttcgcgaagaggagggagcggcaaccaccctgggcggccgcgagcagcggcaactgaaacgcaagaaggcggccagcgtccgccgccgcaagccggaagatgaagaagagggcggcaccacttccctgcggaaacgcacccacatccggcgaacgggcgccaacaccgcggcgccgcggcgcgagaacgtgtcgctcgagttgccctgcacggtgcgcagtttttcggaagccatcggcgtgcccgcacgcacgattctggctaaaatgctggaactgggagcgatcagcaacatcgcggctaccctggatcccgacatggccgagctattggccggcgaattgggcgtgtcggtcaatttcacccgtcccttggacctcgaacagaaggtactccagccgttggaagaggaagaggacccgaccaagctgcaaccgcggccgccgatcgtgaccttcctcggccacgtggaccacggcaagacgtcgctcttggatcgcatcatcggcatcgacgtggccgctcacgaaaagggcggcatcacccaacacatccgcgcctaccgggtgatgaaggacggccgggccatcgctttcgtcgatacgccgggccatgaagcctttaccgaaatgcgagcccgcggcgccaacgtgaccgacatcgccgtcctggtcgtggccgctgacgacggcgtgatgccgcagacggaagaggccatcagccacgcccgcgcggccgaagtgcccatcgtcgtggccctcaacaagatcgatctgccgggggccaacgcgcagcgggcctacgagcagttggccgccaacgagctgctgcccagcgaatggggcggcgaaaccgaggtcgtcaaaaccagcgccacgaccggcgagggcgtcgatacgctgctggagactctgctcacggtggccgagttgcgcgagtacaaagccaatcccgacgggcccgcccgcggcacctgcctggaggccgagatgcacgaggaccgcggggtcatcgtcaagctgctggtccgcagcggcacgctgcacctgggcgatgtggtcgtttgcggctcggcttacggtcgcgtgaaggccatgtacgacacgctgaaagtggacgaacggctcgacgaggccgggccttccacgccggtgaacgtcaccggtctgaacaacgcgcccggcgccggcgagctcttttacgtgctcggcgacatcagccaggcccgccaactggccgaagagcgggccgccgaggcccgccagcgcgaactcagcggcggccggccgcacgtcaccctggaaaccctctacgagcggctgggtgaagagagccaggtgcagacgctcaacattattctgcgggccgacgtgcgcggctcgatcgaagccatccgcaaggagctttccaagctgcagcacgaggaggtgcagatcaagatcctgcaggccacggtgggcggcatcaccgaggccgacgtgcacttggcccacgcctccgatgcggtgattatcggtttctcggtcgtccccgacgaaggggcccgcgtgctggccgacaagctgggcgtgcagatccgccgctacgacatcatctaccagatgaccgacgacgtgcgggcggccttggaaggcatgctcaagccggagcggcaggagaaagacctgggccgggccctggtgcagcaagcgttccacatcagccgcctgggaacggtcgccggctgccgcgtgctcagcggcgtcatccgccgcgatgcccgcatacgcctgatccgcgagagccgggtggtcggcgattatcccatcgagtcgttgaaacgcgagaaggacgaccagcgcgaggtccgcgaggggctcgaatgcggcatcaagctggccggattcaacgatatcaaggaaggcgacgtgctggaagcgtaccatatcgaagagatcgcccggaccttttagagactaacgtcatcctgagccagaacgactgctgagcgagcacgccatgtcgtcgcgacgcgttgaaaaagccgccgaagccatccgcggggtcgtcagcatggcgatcctggcggagttgaacgacccccgcgtccgggacgtcacggtgacctacgtcgaggtctcggccgatctgcggcacgccaagattcacgtctcggtgatgggcgacgaaacgcaccagaacttgacgctgcgcggcttgcaaagcgccgccggcttcttgcaggcgaaaattgccgagcggatcgagattcgctatacgccgaaactgagctttttgctggatcaaggcgtcaagcgatcgatcgccgtggcgcagatcctgcaacaagtcctccccccgcaaaaggccgcgcccgaggacgagccgtccgcgccctcggagccggccgaccacgatcttcacgagccatccccatgaccgccgtcagtcgcaccgcccagtttgccaaggtccacaaggtccttaagaagtactataagtcggcggccaccaacgccgggcggacggtgatcgagcacctgctgttcgcctgctgcctggaagacgcccacgccgatgcggccgaagaggcctttgcggccctggtgcacacgtttttcgactggaacgaggtgcgggtcacctcgatttcggagctgtcggaagtgatggcctgcctgccggacccgcgtgccgcagccaaccggatcaaacgcgtgctgcacgccgtctttgagaacacgttcaacttcgacttggaagaccggcggaagaagaacttgggaccgacggtgaagtggctggagaaactcgacggcacgacgccgtttacggtggcctatgtggtccaggcggccttgcacggacatgccattcccatcgacccggggaccatgcgggcgctccacgtgctcgatctggtgagcgacaaagacgtcgccgccggcgcggtgccgggactggagcgggccgtggccaagtcgaaaggggtggaattcggctccctgctccacgagttgggcgccgactttgccgccaatccgtattcgcccaacttgcgggagattttgcggcagatcaacccggactgcgagagccgcttgcccaagcggcggaagccgcctgagccggccccggcgggcaaagcggccaaggacggcaagccgggcagcgccgccgcagccgccgtggaaggcaaagccaaggcggccgccgacgagaagcctgccgcgcggaagaagccggtcgatacgggcgatgcgccggcggcgggaaagcccgaaacggcgaagaagaaaacgccgtcgtccccagaatcaccggtgaaggccgctgcggctgagaaggcgcttgcacgcagcggcgcggccaaaaaacgcccggcctcggaagggttgtcgaaacgaaagccgcggtgaagacggcgagatccttcgctgcgctccggatgacttgggtcgattttccatgaactctgtttccgtttccccccacggcactctggcgctgcgttttttcctgtcccccttggtgatcttcggcgcggtgacggcggaggggagcggggcttcggccgcgcaggcaaagaagccggttgcggggccctcttcgcaacttctcgaggacgttccccagccgctttccgcccggcagccgctaaccaatgccgagcgcgatcacttgca

SEQ ID NO: 96 - DNA, 9272 bp, synthetic construct
  misc_feature 1..9272: note = Synthetic
  source 1..9272: mol_type = other DNA
ccagaaaatctcaaaaacgtggtgccatagaatctacttatagctcttgacattccttaattattcacctaaatatgaggtgactaattaaggaggggtctccatgtttgcgagagtgaaaaaatccggtctgtatgagtacctccagatcgtccaaaaccggcgggaaggaaccaagaccatccagcgggtcgtcgccaccatcggccggatggatcagatccaagagaagggtgagatcgagaacctggtgcgctccctttcccggttttccgagaaggtccttctgatcctgtctggcaagagcgacgtccgggccgatgcaaggaagatcggacctgccctgatctgcgagaggctctggaaggagatagggatcggtaagatcatccgtcggcttttggcagatcgaaaatttggcttcgatgtggagcgggccatcttcctgacggttctgcatcggctctttgtatccggctcggatcggtcatgtgaccggtggcatcgggattatgtgatcgacggcgtcgacgccctgtccctgcatcatctctaccgggcgatggccttcctgggagaagagatagaagaccagaaggattgtacccccttcgccccgcgctgcacaaaagacgtgatcgaagaggatctgtttctggctcgccgggatcttttcagcggtttggattgcgtcttcttcgacaccacctccatctacttcgagggggagggaggcgagaccatcggcgagctgggccacaccaaggatcaccgtcccgatctcaatcagatggtggtgggggtcattctggacgatcacggtcagccggtctgctgtgagatgtggccggggaacaccacggatgtgacgacgctcgttccggtgatcaagcggctgcggagtcggtttgcgatcggacggatctgcatcgtttcggatcgggggatgatcagcgccgagacgatgacctacctggaggaggagaagatccagtacatcctaggcgcccggatgaggaggagcaaagaggtgaaggaggaggtcctctcccgtgccggccgttaccgggaggttcatccggaaggcgtatccgccaaagacccttcccccctgaaggtcaaggaggtaatcgtggacgggaaccgttacatcgtctgcctgaatgagaaacaggcccggaaggatgctgcggaccggcaggcgattattgcctccctggaggagaaactcaagaccaatccgaagtctctcttgggaaacaagggttaccggaagtacctgaagctggatcgggataccgtttccgtaaatcaggtgaagatcgaagaagaggcgcggtacgacgggaagtgggtgctcaagacgaacaccacgctgacggcggagcaagcggccctgaagtacaaggaactctggcaggtcgagcaggtcttccgggacatgaagtcggttctggacacccgtcccatcttccatcaactggatgagaccatccggggtcacgtcttctgcagtttcctggccttggtcatccggaaggagttggatcgcaggttagagaaggccggccactgtttcgagtgggccgacatcaagcaggatcttaaggccctgcaggagatcacgattgaagacaggggcaagacgctcgccataaggagtgagtgtctcgggacctgcggtaaagttttccaggcggttggtgtggcagtcccgtcgacgatccgggaggtggcatgacgcaaaacacgttgtcaaagagcaatctgtggtgccaagaactttttcaaggcagatatctatttaaaatagtggaactattttttggcaactgttaaagatcagtcttacataaggggatgttataggacccgtttttttgtcatggcacccgcaaaaggaaaagagagcaggctccaggccaaaaaaattccctcattattttaccggccacttttttgatggatgcgcccttttgtttattccgcttcgcgggattcccccctgacgtcccccaaggggggcacagttccttgcgctccgccgtcgcagccgccagggtcgtgccggagcgtcgctccctgctggctttgtgcgccagctacgcgcttttaatccccccttcaaggctcccggaaacggctttgatcgcttcgggacgctcctccgtcgcgatcctcgccctcttcgccgctcattcctgacgggcagatcgtgcctttcaccttgtgccgcggtgtcaaggcaccatccgccctttacacgccctatggatgcaccatttcactattccccccgcctccctggtgatcatcagcccggcaagccgcgcagatcatcacctccggcttcgccggcccgtccgcccccaagggggctcccctgtcctccatccccataagagcgaagcgccgtgatgtttctacgcccgccgctgggctccgaaacattccgccgcaccgctcccgatgaatccatgagaaatgagaaaatgcttgccatcagcggtcatccgatgtagaaagagcagtaacccatcataaagcacgttattctcaagccaggtcctgatggagcagatccactatggttacccttggtgttgattacggtgcttcaagcgtagggcttgccctggtccgcagtgatgagaagggccataacatccctctttttgccgggacgatccgattagacgcccgttggttgaaagagaaggttgaaacacgcgccggtatccggcgattgagaagaaccaagaagaccaagatacaccggctgcgccagcttgagcaatccctcgcccaaataggtctcggcgcagaacaaatccactccattgtccgtttcagcaaccgcagaggttataaatccctttttgatgatggcgtcaccgatagcgatcatgatgaggctgaactgacctacaggttcaccagggaagaattcttcaaggccctcagtatcgaactccaatcgcttattcccgaccttattcagcggcaaaaggctttgtccgcctgtgaggtgatcctgaacaggcaaggactcccttcccgcgagatccggcagatcaagatcgacaaccgcggggcaagccgctgtgcatgggaggggtgcagccgggtgacaccccggtccgataatgccttgggggaagttctctctcagcagctctacaccctctttcagtccacattgaagggtaatcccgacttatgccagaaggtcgaaacggccacccatgagttgcatgaacttgccaaaaggctccgccatgcctcgggtgagtctgcgtccagcgaaaagaagatcctccggaagaaggcgcggaccattctccgggctttgaaagaattgctctacacccctgccgacggtgtcggggacgctgagaaggcttggaaatacatcgaaacgggcatgatgaatatcatggagacccgactcgggagaaaccgctattgccgcgaacacagcagggaatatattcagacgatttgctcgggaaagccgattccttttaagcaaaccatatccgactcggacatcatttccagacgcgaacagatcgcctatgcaaagctgtggcgttacattgaggcccgtatcctgcctcttgccccagcagaggggattgaccgggtcgtcgttgagcgaaccgctttcgacctcctggcgggaagctggaagaccatccagggcaccaccgatcagttcaaggaggagatgtatcagcatggccccatgtacggctttgaaagcgtaccggacatgctgaaggaggaattcgggggtctgtgcgcatattgtggtcaatcctccaacaccctcatcgatgttgaccatattctgcctcacgcggatttcctttttgacagttacctgaacatcctcccggcctgtccaaagtgcaattccgatctgaagcgggatcgatccatttccgatctttcgttggccatccatcccgatgcttacaaggcgtacagcgattatctgaaaaagaagttcagcacccgtcccatgcactttttccattccatcaaaaagggtgttctgaacctgatgcaggacgtaaaccgcctgtgggaagcggaacgatatctctccctgattgccagacagtttgcccagatcgttcaatcccagcgaggcccccgacccttcgcccgttacctctccacaaagctggcagtcaagcagggtgaggctccggaaatcaggttccgcaatggtcgtcacacagccctttaccgccgtgttgcctatcctgattttcaaaagcaggcagagaagaaagaggggaacgtcctcaatcacgccctcgatgccatcctgttggcttcagaacttccggatttataccccgtggaatccctaaatcttcctctgtggcagttaaagaattgggttgcgaaggtgaggtcaagagcccccaaagcaggggatgaaggtattccggtatgtccgggcgggccgcaatatgtcgatggatttgagacggttcacctcggtggttacgtggaagtggagttgcgatccatgctctggaaccagaaggacagcatgacccacaagcaggacccttacggcttttctgaaaaaacagggatgccgacgaagaggacttccgcagtcgatctgcacgctgaattaaagaaggaaaagaatctgtcaaaggtgaaaagccggattgcgctgatccatcacccggcgttgagaaatgctttacaggagagcctttcatccgatacccccggaccgtctgcggcggaagcgctgaaagcatggcttcgcatttctgttagaaacagcttggcccattcccgcttttccaaccatcccggagatcaggccagaaggtccgagctggagaagtttgctacgcaggaagactgtccaatcccgacggtaatcggggccaagatgtccagtatgggtgtccgcggcaagattgacctaaggagactggacagacagacgggtgggatcgggcatcgctatatgacccagcctcccaacaaaggggtcatagtggcctatcccaaacgggaagacgggaaaccggatctgaccaggccttgccttgtctatcacaaacaggatttgtcggtctcatctgaaaatatgagaatcttcaaaccgctgcctccgatcctgtccgatggggtgatccttggaaaaaagatagttgataaaggagatagacgcagggcgcttgaaaaatacctgtcggattgcggctttcacagttacatatacttgacaccgggatgtaccatccgctacaaagatggcactgaatggtttgtacgaaattttgacaccgacgaggatttcaagaagggcagactcaaggaaatcatcggcacaaggcggacgccctttattgacagtctgacgcaattgaaaaccctgtcccaatagggattgaaggtaaagcatcaaacgttctttgacaattcagaagaaatgatcagttccggttgaaaagagcatccgtccggagggtgcactccgggatggggcagtcccggcacttgcgttttccccggcttacgcttcggaaaaaggcccttcggcacgtcggaagacaggatgtgagcccaattcaattattgtcacgtttttttgattcacgaaactgatttcagatggtcgttttgacttgcagacttgttaagggactaatggcttatgtggtggtttcaatcaaactgatttccgatagtcatggcgacgtaaacgctccccaaagcttgcaggctgtgaaatggtttcaatcaaactgatttcagatagtcattgtgacccacttaatcccttgacggttccggctcaaccctggtttcaatcaaactgatttcagatggtcattgtgacttccctcctgtttttttaatccgttcgcggaaccgtttcaatcaaactgatttcagatggtcattgtgacttattttttcctcctcaaacttttattctggcgggtttcaatcaaactgatttcagatggtcattgtgacacaatcaaatggcgctttgcctcaccatagtaatagtttcaatcaaactgatttcagatggtcattgtgacgatcgcgtgaaaaagattgtcacggccttaatcgagtttcaatcaaactgatttcagatggtcattgtgactatctgactgaattgtcaaagaataacgatgccttctgcgtgcctttccgcgaacctccggagatcggcggatttttcggggttctcagggcaagcgtgcattgctgaacacaaccaaatacacatatccacgatgcgacggatacccggaaagctgttgaccaaatggaaggctttttgaaaagtgttgactaaaccgttgaccaagtgccccttaaagtaaaagagggctaaccgatgaatcagctaaccccctgtttctcttatggtgccgaagccgggacttgaacccggacggatttagtccactaccccctcaagatagcgtgtctaccagattccaccacttcggcattcccgtctgacccggaatcgccgcttcgcgataccctgccgacgttgccggaacttacccgttttcaaattgctttgtcaatatcaaaaaagcatatcaaaaaagcatcgggtctttgcgcgcatacagcctacttcgccgtctgcggagcggccggggcctgaggcgccggggcggcagccggggcaggcggcgccgccgggttcggcgccggaaccgttttctgcgcgaccggtttggcggcgccttccatcagcaagctgcccttgtgggaaaccgcataagaaaggctgagcgaggtcagcatgaagatgatggcgaccgcggtcgtcatctttcccagaaaggtccccggaccgctgcttccgaagaccgtctgactggacccaccaaagaccgcgcccatgttcgcccctttccccgcctgcaggagcacgacgaggatcagaacgatacatgcggtcacatgcacaatggttatcagaatctgcactttttcataccccttgaatggtttgatatccgacaagttggacgaaagaagcgacgtccaggctggcccctccgaccagcgccccgttgatgtccggctggcgcatcagatcaacgatattcttcggtgtgacgcttcccccgtagagaatggcgatctccgccgcccgttcacttccataccggccggcgatccattcccggatgagccgatgcacctcttccgcctgcgccggggtggccgtcctgccggtgccgatcgcccagaccggctcataggcaaccaggaagcggcttatatcaccggcggttaaattattcaacccctcttttaactgccgttcgacaacgttttgcatccggtcctcttcccgttcctgcagggtttccccgatacagaagatcggcttcaggcccgccgaaagggcggctcggagcttccggtggatgcgttcatctccctcgccgaagagggtgcgccgctccgagtggccgatgatcacatacgcgcagccgacttcgcggatcatttctccggagatttccccggtgaaggcccccttctccgcttcatggaggttctgggcagccagacggacgggcgaccctcggaggagctccgcgacggcgtggagcgccgtgaagggcggggcgatgatgacctccggctccggcggggcggtgagggcgttccggaggcgcgaggcaaaatcgatcgcctcggcgaccgtcttgttcatcttccaatttcctgcaatgaccgggcggaccatttttctatcctccagatgaacggcggtggtcgtgcggggcggaatatcccatccggaacgcatcaccgctcttgtttccgtatcgggcaaagacccaaacgaacttgccgcggatcaccctgtccggagcgcgtccacgactgccgaacaggggctgtccctgaagtcaaaggataccggccccttcgcggcgatgccggtgatccccttcatcttctcccggcaagcccatccttcgacggtctggaatgacgcttcatgatgaaggaggaaggatcatagccagccagccgatattcgtcaatgttttttattccgttttttattcccggaaaagttatgaattgcaatatttgcaaattcacgttagtctgccggcatggatacaagcgaaaagaccctgcaactgacggccctggaaatcaatcttgaaagaaccagagcggttgtggatatccctgaaaaatacaggattctcctaagtgtcgccaagaaccattacggggtgtcgaagcgaacggaagaactgctcgttgagcttcatcacccgtttgtgaactgggagtaccttcttgtacagctcaaaggcctttccataggcgatttttatgatttcaacacccacgaagatggtttatccgcactgaaatcctttgcagaaatttatcttaccgccatctcttcggccggcaacgaggaggttaaagacaatgccgtccgttattgcttcgaatatctccataccgttctttccagcagcggcaaccttcaggaaagaaacacggccctgttttcacccgtctttcggtctctcgccgatctgtcgcggacgcagagtcatttgttcaagaaatcatcgagttatatgaaggccattgccagactgatgatggagaatcatggggacacgatgcggcatcatgtccccattctggatgaggtcaaccgactcctcttttctgccttcaaatcgacgtatcggtactggcttacgcaacccgatccttcccaatggttttccccggatggcgagacaaaggaagatcgcgacgcctatcgtgagctgatctcacctctttcccacgaacatatccgcaggctgctctcccggctaaaagaccctgatcaacatgcggcgaccgctgcggatcagcttgcaccgtacctggatatgcccgaccatgcgcagatcgcaaacggttatcttgtgattgccgatgcccttgaaaaatcaagcgcctttgagggacgccgttatctcgtaaagctcaattttcttttcaatttgatgagtgtcgccgggctgtcggatatccacaacgcgggcctgatcgagatcaatcgctgcctgggaagggcgttgaaagaagaaagcgatcggaatatccatgatcttgtgcaaaagatattccgtttattgaaaaaaacggtctcacagaatcaataccggagttcgatcctcgattgcatcaccacactggcc

SEQ ID NO: 97 - DNA, 12967 bp, synthetic construct
  misc_feature 1..12967: note = Synthetic
  source 1..12967: mol_type = other DNA
tagtctgactaagctgtggaaaatgcagcggaggtgcattacccggagatgattaagagccgtctttgtattacaagcaaaggcggttattttgtttttggtggagggatgatgaaagctaaaacaccatgtgaaaacgaccccaattccctttctgtataagagatgattacccttggcattgattacggcgcctcatatatcggcgttgccctcgtggaaaacaccgggaccggcaatatacctttattcgccggcaccatcacaatcaatgcccgtgatttgaaaaatatggttgaaacacgggcagcaatcaggcgcctcaggaagctcagggaaagccttcttgcctgcggcataggcgcggatcaggtcaacctcatcgtccgcttctgcaggcggagaggttataaatccctttttgatgaggacgaaagcgaaacccgcgaaaaagagagcgacctcgcttaccggttttcccgtgaaaagatttttgaaagcctcgaaagggaactcggcctcatccttccggacaaccacctgaaacctcaagccctgtcagtctgtgagagggtcctcaaccggaagggagaccctttccaggaaatccgccttatcaggatagacaaccgtggagccagccggtgcgcctgggagggctgtagcagggttaccccgaggcgcgagaacgccctcactgatcctatcgcccagcagatttataccacatgccaggaaaagataagagaaggaggagagcgggcaagggaaaaggtggacgatacggtcactcagcttgccaccctcggcaagcgcatcaggaacgcctctggagaaggggcaaacaaagaaaaaaaagccctcaggaagaaagcgcgtatgctcctccgggagataaaggaactctattaccagccggccagggagaccctggatgatgagaaggcgtggaagtatattgagaccggcgtcctgaacatcatggaaaagtcaaaggggagaaaccgttactgtagagagcacagccccgcctacgttaaaacagtccttgcaaacgaggcaatccctttcaagcagaccatatcggagtcagacatcatctcgcggagagagcagattacctatcagaagctctggcgctatatagaggcacgggtgcttcccctcgcgcccagcggcattgaccggatcgtcgtcgagcgcaccgctattgacctgcttgccggcagccgcaaaaagattctaaaggcctcagaccaaaccaaagaggagatatatcagcatggacccatgcacggatttacaagcgtctcagaaatgctgcgtaaagagttcaatgggctgtgtgcctactgcgggaagcaatcggattctctcatggagactgagcatatcctgccccgggcagagttctttttcgacagctacctgaacctcgtgcctgcgtgcccccagtgcaaccagaggaagggagcacgcaccccctcggctgcttccctgaatattaacggtgaggcatacgaggcatatacaaactatctccagagcaatatccgcacgcgccctctccactttttccataccatcaagaagggcgtcctgaacctgatgcgtgaccctgaaaggcagtgggaggcggagcgttacctctccctcatcgccagccagttcgcccaggtcgttcagacccagcgcggaccacggcccttcgcacgctatctctgttcacgactgtcattacgccaggacatgaagcctgaaattgcattcaaaagcgggcggcacacagcgctctaccggaacatcgcctaccccgatttcagcaaggttgcagagaaggaagaaggagggataattaaccatgcagtagatgccaccttgcttgcgtccgacctaccagacccgaaccctctggaagcgctcggcttgtctcctgctgatatgcgcaggttctgcagtgccgtcaggcagaaagccccgcttgcaggtgatagcggcgtgcctgagcctcccgcccgtgacttctttgtagagggctttgaatctgttggatccggctatgtaaaagtgaaactcgattccatgtgctggaacaagcgcgacagcatgactcacaagcaggacccttatggctggtcagaaaaatatatgttgccgaccaagcgcaccagcgctcttgacctctggagcgaactggaaaagatgaaagatgaaaaagaagtgaaaaagaaaattcaactcattcatcatcctgctttgagaaacgcattctcagccgccatcagcccggcaaaccctggcaagtcagcggcaggtactttgagggcgtggctgagcgaatctgtgaaaaagagcatccagacgtccaccttctcgaacaaccccggcgaccagcaacgcaaaaaggagcttgagcagttttctctctctgatgagtcccctatcccggcgataatcggcgtcaagatgttcgatatgggtgtgagggggaagattgacctccagaggatagacctgcagaccggcagaactggacaccgctacatgacccagcctgcaaaccgggcagtcattctggcgtatccgaaaaagaaaacaggggggacggacctgtccaagccctgcatcgcccgggtgaggcagaactatgcacttcttcctgaggaaaaaggaatcttcaagggacttccggagagattgaaggagggcatgatactcgggaaaaagaataccatcatgacaggctgggacagggaggttgaccattacctctcagattgcggtttcagcagttatgtcatgctcacggcgggatgtgttgtctgctacggagacggcaagcagtggttcctcaagaatttcgataaaggcaaggaattcagaaaagggaaaaggctgaggaacgtcgttggtatcctgaggacacccttctccggaagaatgatgctgttaaagcctttgacttaggattcataaggtggtaaccctttaccacgctgttctttgacaatcaggaccgaatatcagttccggttgaaaagagcatccgcctgagggtgcactccgggatggggcagtcccggcccttgctgttcccctggtatagcaacatgctccgggagcaaaccttaaggcatgtcgaaagacaggatgtgagcctttttatcatcgagcgattgtttcaatcaagctgattctcaaacagtcattgcgacagatggcctcttatgagattgagtggaagggctcgtttcaatcaagctgattctcaaacagtcattgcgacgcagttcaaacagcgtcccccgcttatttttgggtttcaatcaagctgattctcaaacagtcattgcgacaaaatttgcgccttgcggtatcgctcccgcaaggtttcaatcaagctgattctcaaacagtcattgcgacagagcagggacctcttataccgtctcaccgccaacgtttcaatcaagctgattctcaaacagtcattgcgactgcggttctgatttgtcaaagaaaagcgatgtgtcaacagggtatttccgcgaaccctgttcttgctcaccgctaccaatggcaaaaaagatacatagccatgtcttaaagtgttttcaacctgttgaataatatccaagtattaaatttccgcgaaccttgtatgcgagagcttttgtactaactgttgtataataatttggataattgaaataaggcaataagaggtgtattgaaaatatcaatgaaagttgaagaattaataattcatcttccgactttgtctcttgtggttgataagaaatggcttttaaagaaacgtgattgggctgagtcctttatccctccacgcttaccctggtttgaacgggttgaaaaagatttcaatatcctcaacaaacatttaggtaccaataaacttagaaaatgtttcagaagttctcttcaagatgaaagagttgaaaggggtcaattctttatctttgattaaaatagattctgataaaataattgttgtggagcagtaaatattgacaaagatcaacggtatgatatatggtaataccaggaggtgagaggtgagcacagcaaaagttgcaatatcaatagatcgaaaacttcttgagcagattgaccttctggtacaggaaaaaaaatattccaacagaagccaggcgatacaggaagccctgaaagataaattgcgaagatggcagcaaaaacggttagcgtcggaatgtgcaaagctatcagtaaaggaagaacgtgcattatcggaagaaggtcttaccgcgggagatgatgtatgtcccgaatattgaggggtagcgtatactgggccgacctgaatccagttcgaggtcgggagcaagctggcttacgccccgtattggtcatcagccacgatatatttaatgagcgttccggtacagtaatagcaatggcaattaccagtaaaccacagaaagcaggttatcccctgtcataccccatgaaaaccatccgtttgccaaagccatcctgggtgaaaattagccagatacgaaccctttccactgagaggttggggaaaaagatcggtttgatttcacctgaagaattaacagatattgtggatggtctcttcgaattagtgcgttaattattgattaattcatacactgtctaacagaatattttatggaacaggccctctttgtctcaaaggttgataacctgaaatattttgaagatactgacgaattatcccgcctctatttcggaattgagttctgtgagaggcttatccctgatgcagctgatctgaaaaaggtaataagctttgtcaatgagaagaaaatagatttcacgctggttactccctatgtgacagaagacggcctggagagagtcgaaagactcctcgggacgctggctgaaacaaagcctgggagcgaagtggtgtttaatgactggggcgtgttccaggtgatggatgaaaaatatccgggcctgattcctgtgctgggcaggatgctgaacaagatgaagcgggggccgaggcttttgaatgtgctggacaagatcccggaagagagcgtgagatattaccggagcccgggcattactgttccgaaggtaagggaattcctgcttaaaaatcggataacccgcgtggagtttgacaaccttctccaagggattgacttggagaggacaggggatgagatcaaaaagaccctctatctgccttttgcgtatatcaccaccacccgtctctgtctgactgcattatgcgacagaccggataaggtgaaagaagtgggaattacaccctgcggtcatgaatgccagagatacaccttttacctcaagaatcccataatgattaccaaccttatccgaaaggggaataccatctttttttgcaacgaagacattcctgataatttaaatatgtttgaccgggtagtaattgcgcccgagataccaatctgataaggaaaccatgaaaatcctatcccccttagatagcaaggaagaagtaaaagaattaatacaggcaggggctgatgagtttttctgcggcctgctggaggagacctggcatagaaagtatcctgtcatctcgatcaaccggaggccggcaggaaaaggtcacttccggacctttgctgatttgaaagaagcggtttcgatggcaaaggagcacaatgcccccgtttacttcacagtgaacgagcattactatattgacgagcaatatgacctggtgctggattacgtgaagaaagctgtagatgctggtgtttcaggaatcattctcgcagattacgggctgctcaccgtcctaaaggaaatgaacctatcggtcaagctccaggtcggaaccggaggaaccgtctttaactctcagtcagcaagattttaccagagaatgggtgcatcaagcgtaacctttccccggcatcttaccattgatgaaatcaggaaaatagttgaaaactctccagagatcgagttttgcgtcttcatcatcaattcccggtgtgtcaatgtggacggattctgtacctttgagcacggcctttcggatcaatcgtgtttccccctctaccggaatgcctgtatgcttccctatcatatttccctctctccacaggtcagcgctgaggagcgggatatgggggatatcatcagggagcaccgctttctggagcggcagcacatatgggagacagtgcacgtagatgaccacccctgtggcgcatgtgccctgtatgaattcagagagatcagaattaacggcgtgaaaattgtggggcgagggaataccctggagagaaaggtaaaggatatacaattcctgagaacgcttatagacaggcttgagagagataacctgtccatgattgatttcagaaagtctgcacgggaactgtatcagaatacctactcccgaccctgtcgaatgcacatgtgttactaccctgaagtgatggaaatgccagcctaaaatttgcttgccgcctgtttccgttcatggtaaatttaatttgatattctaataattacttgataattatttaggaatctaactatattccctgtaggagttttctttgaaagagggaatgaagtaccgtttaacagaactgtgcggaagaaggcttgggatctatacaggtgccggcacctctcattcctggctgtggtttgtggatgtccttgagaggatggggcttgataacctcgtctgtatggatgaaggtgacctcaaaaaaggggatgaactgacgaaagtgagcgcactcctcatatcagggggggatacctttgccatcgcagatggtctgggcagggaaggagcaaaaagcatagaacagtttatttctgaaggcggcgtttattttggctcctgcgctggcgcctatctgcctttgaaatcttcaaagtatcccttaaacttcctgaatcttgccggagtaaagatcagcaatctttcaaaacatcgcccctctccactgacacagtcagaaaaattctgcacgccctacgggtgtcactatgtgttccatcccgtccgggacgaagtaaagataagattcacgaatggatactcctcaagggtaaaggaggaaattagcgccccgctctatggcggaccctgcatggaaccatcagaggatgtgacgccgatagctttttatcacggtttcacagacaggaccctttttctggtagatgaaaatcttgcagaagaaacggtgcttggcaagacggcggtgtgcagcaaagcagtggggaagggcacactatatctttccggccctcacctggaacatcccttctatcctgaagccaacgaattgctccttgatatgctgtgtgacggcctccaggagaaacaggtttcttcacgtgctgatcaagagattgaagcaggggttagggtatcccgtgagcttttgaaaggactgagaagagagctgagcggttcacggattatcgccctcgctctggagagggagtctatgtcatggctcatcgggaacaaagtctatgagccggagaagttccgggtgttcattgaagcgctctggaaccgcctcggccttcttgaaaagctttcagataagagtttgtcaggcgaagacgttcagagtcttaccgcctgcgcaggtatggtgagagagaaattaaaggtgctcaagactgagatacaccattcatcagataccacagaactggtggaggatattttgtccggtctgcgaaccctggcatcttcctttatgaatctgtatttcaggttgaaaagacaagaacacaggtaggaggaaaaaagaaatgtacatgtactacgaagcccaatggagcctttatgtcttaaccgtgattaccgtggtgatattcctggtcggcgtttacgctaacgtctatcttatacggagggggaaggcaagaagccttacgtataaattcaatcctggtgccatgctgaaggcgctcatcgttaacgtgatatttcagagcaaactcttaaaacagagttctctccgctggttcatgcacatatcgatcttctggggattcatggggctcctggcccacacgacgtttcttgcatattactcccactttgtgtctcctgattcagcttcggctcaattcttttttaccccccactcagcaggaagactcttcctcgatttctggggagatttctggggaacactcctcctgatagggtgctcgatcgccatttaccggaggtacgtcagcaaagtacagcaactggacaccgttcttgcagataccctggccatttttctcttattctccgttacagccacggggttcttttgtgaagccgtgagatttttgcccttgcccccttcccctgattttaactattcattcttaggatacggtttaactaagatcctaaggttaatgccccagtctactatcaaataccttaaatatactgagcaggtccgcaatcatctcatccttggaatatttttaattctctatataccgttcagcaagatgtggcatatctttgtgagccccattgaagtgcttttggatggatccgaagaacatgcgaggagaatggcatatgagcgataatgaaacccatgaaacgaaagtagaagaaatggaagctaaggtagaaaataacgaagccagaataatcaagatcgacaacctcagcccccggcagatcatggaactggatgtctgcacccgctgcggagaatgcagcgtgtggtgcccggtctatgatcaggataagagagagactgttaatccacgcggcagggcacggtggttcaagaagatcattaagtcacagtatggtcttttcaggccgggaactgtctgggggaagatgctgcgcagaaaaccggtgacagaggaagaaataaaggctttcacgaatgatctctatgaatgcagtacctgcaggcagtgttatgtagcctgtccggtacagattgatacggttgagctctgggagagcatgaggcgttcaatagttgattcaggatacggacccctcgaacaacagaaggccctggccatcagcgtaaagtcttacgataacccatggcagcaaccgcgctcatcgaggtcgcgctggaccaaactggctctcaaagataaaaaggtggcgaaagagcccaaggatattacaaagacaaaggcagaagttctctactatgtagggtgcacagcctcatacgatgtgaacgtgaaagaagtggcgatttctgatgcccatatcctcgaaagggcaaatgttgattacgggatacttggcccgaaagagaaatgctgcggaagcgtcctcctccgtgtgggagatcacgagtacgaaaggattgcagaagagaatatcaagatgtttaatgatctcgggattaagaccctgatcacttcatgtgccggatgttataagaccataaagcaggactatgccaaggttgggaagctcaactttgaagtgaagcacatggttgagtttctcctcgacctcatacgtgaagggaagcttcagttcaaaaaggagctcaagatgaaggtaacctatcatgatccatgccatctcggaagacacagcggagtgtacgatgcgccccgggaaatcctcagggcaataccaggaattgaactggtcgagatggagcgttcaagggaaaattcacggtgctgcggggcaggaggtggcctgaaggcgggattccccgatatccagaatcaaatggcgcagacgagggtcaaggaagcagaagcggtcggggcgagcgctattgtttcggcctgtcccttttgttaccaggggctgcagatcggtatccaggcgttaaatttaccgttgaagatgatggatatcaccgaaattgttaccatggccctagacgaggctgagaaagcttgatccgatatacaacattcttctttgaaatttttaagaataccccacaaatacgtgtggtgtatttttttacgagttatgcggaaagggtttcatagtgtctttgcgaggaactatagtgacgaagcaatctaaaaaaagacatacacaaactgactttctggattgcttcgcctggctcgcaatgacataaggattttaattgtgtcaatgagacgattgactgtttttattttttttatcttgacgctttttcctctctgctcctgtgcacagaaagaggtttctgaaaagaaaatccggcttgcctacatccagaatgacctccaccacctcccagcttttgttgccctcgataaaggatactaccgggaagaagggctggacgtcgagataaccggagccttcagggcaggaccagaggagatgagtgccttctcttcccacagccttgataccgggtatgtaggtgaagcacctatcattactgctcaggcgaacaaggtggctgatgtaaggattgtcgcacaggcaaataaagagggttcagccctggtggcggcaaggaattcgcccatcaagaatatcggtgatctgagagggaaggttgtagcaatcccgggccatgctacgatacaggacgtactcttgaggatggcattgaagcggtcaggaatcaaccctgccgaacttaccattatggtactgaagcctccggagatgctcagtgcattgagttcacggggaatagacgcctttatcgcctgggaaccctatccttccaaggcagtgaccggcggtacgggaaaagtcattctggactcaggctcgatctggaaagaccacccctgctgtgctttgattgtagaccgggttcttatgaagaaccgtgatgtggtcaaacgtctgatcagggcccatctgaaagctgtcagatttatcagagacaatgaaggtgaagccagaaacattggagtcaaatataccggaatggatgagatgacggtacgggaagcgcttaaaaggatcaagttcgatccgctcccttcacggcaggacaagaaggagtttattgaatttctcagggaattaggttatataacaattgagaattctgataattttattgatgagctcatggatgtaagcctgctgaatgaagttgtaagggatgaaaaggttattcaatagatatggactccttctttctttgctctgcctgtggcaactcctatcggtttttcaggtcctgcccgcttataaaacgccatcgcccatcagcgtactggtcggtctaaaacaactctcgactcagggcttgccttctggttaccttctccacaaccattgcctccagagcctctaccgggtatttgctggattttttattgccgctctacttgctattcctctcgggattatcatgggatggtcaaggtcactgagggaatcagttacgccgctgattgaggttctacggcctgttccccccttagcctggatacccctcgctattctctggttcgggatcgggttcaaatcctctgtttttatcattttcttaggatgctttttccctatcatcctgagcacgatttcaggcgttttgtccattgattcaattttaattgatgcttcaaagactctcggcgcaaggaaaaaagagatctttttaaaggttttaactcccggctccctcccttccatactaactggcctccggatcggtttgggtatcggctggatgaccctggttgcggcagaatttaccggcgtaaggagcggatacggcctgggttacatgattatgactgcccgggatattcagagaccagatgaagttatagccggtatggccatcatcggactcattggctatagcctcgatcttctcctgagagggatcgaatcccggctgcttatctggcgctaaaggaagaagacggtaacgtgtccttagagctgattcatctggacaagacatatataagcaaagaagatggaaaagaagtagaagcgttaaaggatattgacataagaatcgaagagggagagtttgtctctcttatcggtccgagcgggtgtggcaaaactactttgctccggataatctccggcctggagaagccatccggaggaaaaattctcatcgacagtcaggatgtggatgagccctggttgcaggttggcctggtctttcaggaatttgccctctttccctggaggacggtaagggaaaatattgaatttggtcttgagatgaaaggaatttccccggaagaaagggggaaaaaggcagcggagtatgtcagttggttcgggctggatgattttggaaaccggtatccaaaagagctttctggaggtatgaagcagagggtggctatcgcacggacattgatcaatgaccctaagattatcttaatggacgagccttttggtgccctggactctcagacaagattatcccaggaggaatttctcctgaacttatgggacaggacaaaaaagacgattctctttgttacccataatgttgacgaagctctttctttgagccagaaggtgattgtgttttcccgaagacccgggacagttaagaagattttcttcatagcgctcgattacccgagagatgtaaacagtgatgtgtttaatggcgtgcggagagagattttggagtatctcactgaagaagggatgtaaagtaaagaaataaaagtatcatgggtaccgatttaaaattaagagaagttgtcaatgatctccagtgcctcggagtgaaaatacgtaagcctatgagtgtgaggagaggcggggcagggcctgctgaaggtcaggtgatcatattcaaagggataccggtcagttgcccggttgcaagcccttttgtgaaagattccccctatgtgataaaacggaatggcgcaggtcatatcctggaaaaaaatgaagaatatatcgcagagattatccttccctctgtcccccgtttctaccagaggaaaacagcagacgggatcccgtattcccagatcgcaa

SEQ ID NO: 98 - DNA, 4631 bp, synthetic construct
  misc_feature 1..4631: note = Synthetic
  source 1..4631: mol_type = other DNA
tcagaagtgaactctaaacttcccgttgaataactcaacatatccatcctctcatcggtcggttgagtctactgagaccctcggggaaggatgtactttatttattgttgaaatattggataaattgaagatccaatcgattgaggagtacaggaagaagtcctcaggggcgagacactcaatttatgacccctttaaacatccaccctctccaattctcaccccctccaattctcattgacacactgtttgattcttaatacaatcaaatcgaattagaggctatccgttattaacctctaacccagagggtgggatatggtctggagacgtatataagacctcatttctgaaaaaggaatggggttctgttttttgcattggtgattcctaaaagggagatggagacaaaggtaacgctatcaattgattttggttacaaaaacattgggattgccctggtaaggaaccaggagggaacgaacatccccttgttcgccggaacccttctatacgacccttttcaactcagcactaaagtaggtcctcgtgcggaactccgtaggggtcgccgaaccagaaaaacaaaaaggcataggctgaaccgtttgaaacgcgtattattgtcattaaatctatctggagatattattcaacaactccttactttttgtcggcgcaggggatatagctctttattcaatgggaaagaaatccctgaaactgggaagaaagattcagaagaaatcatcttccgttttagtcgggaagaattttttaatgcattggaaaaggagataggaaagctacttcctgaagaaaaaagagcatccgttcttgccatatgcgaggatatacttaaccgagctggtgacccatcaaaagaagtccgaccactaagaattaacaaccgaggagcctcacgatgtgcttgggatggatgtgagaatgttaccccacgccgtgataatgccctcagggcccccctatcgcaattcattcatacagtctttgcgtcaagtctgagagggaatacccaattaaagcaggaagtctcaaccatgctggaccgtatcaccctattaggtaaacggcttcggcatatcgggggacttaatccggataaagagcgaaaagttttgaaaaaagcaataggtgatgaactgaaattgttgaaaaatctatctggtctaagccctgattccgatgaagaagctgccaccccttggacacggattcgccgaaatataatgaacctaattgaacagacaggaggccgcaaccggttctgtcgtgaccatggttctcaatatgtcacctattttctggagggaaaacgaataccctttaaggcaaccttaactgaaagggatttagtatcacgccggcaagaaattctttttcaaaagttatggcgctatattgaggctcggattcttcatcttgcccctgacggcattgaccgagtgatagtggagcgcacggcaattgaccttctggccggaagccgaaagcagcgccaagacataatgaacaaagaggctcttgaggagatgtatcagcaaggacctcgatacgggtttaaagataacctggaaatgctcagaaccgagtttggggggctttgtgtctattgtggcaaacaaaccaatgaattggtagagagagaccatcttttgccaaggtcaaaattttttttcgatagctacctgaatcttgttccctcctgccctccctgtaatcgaacattgaaacaggcggcctcaccaggagaagccgcccttaggatagataaatcggtataccaagcgtttgctcaatacatggatacgaaatttaaggataaacctccacatctttttcacaccatcaagaagggtatcctcaatctcatgcaggagcctggccgcatctgggaggttgaacgctacctcaacctcatcgccaaccagtttgcacaggttgtggggactcagaggggaccgcgccccctggcccggtatctcagcgggaagctatatcaacggtttggggagaaaccccagattggatttgtcaacgggagacacacagctctttggcgaaaggctgcttatcctgaatttgataagtttagagagaaaaaagagggtgggattatcaaccatgccctggatgcacttctgatgggttgtgacttgcctgatttgaccgcacttgaagcgaggaatttgcgccctgacctgatgtcttggtgggttgacaaggttaagaaagcagctccacctgaaggccgagagggaatccccgtgatacccgaaccacggtttgtagtagctggttttgaagatgttctccctggaaactatatcagggccgatttggcaaagatgaactggaatcgtaaggattctcagacccaccgccaaaattcctatggctggtcaagaaaggaggacatccctgttcagcgtttgaccgctgcaagtattgcaaaagaccttcgcaaggctgacaaagaagcctctccagaattgaggagagccgaggtcaagaaaattgtaaataagattatccatccaagacttaatcaaaccttgagagaggcaaatattggcgacaatcctgggtcaagcacagcagaagcacttgatgcctggttgcgaaaagcgattaagggcaacttacaagagacccggttttcctcccatcctggcgaccaacgcagagcagaaatacttcatgattttgttgctggccaatttgatggaatccctgtagtcattggagtccaaaccctataccgctcccgtaagtcaagtgttgatttaaatcgggttgatactaaaagccgcgaggttttacaccgatatgacgctgaccctgcaaatgtggcttacatagtggcctaccgaggaaataacggtagggtcaaacgggatagaccattgactcttgaatggcgacagagcggggctgtaatccccaatgtcaaattgtttggagaagttcctgaagggccattaaagggacgcgccttcggtgaaaaagcaattgaccaatcaaaatggaaggcagctttgaatcaatatctcgccaaggcaggaatagctgaatataattttgtatcgcaggggaatgtggtggtttgtgaggatggtagtgaattttatattaggaatttttcgggcaactacggttttagaaaatcttggttcaagggaataaaagcggttcgaccttccccgctgacacagcgattgattccaaacaaaaccgtttagaagctgtgattttgttctttgacaattggatagcgtgttcaggctcaagctgaaaagagcatctgttcggaagggccactccgaattagggcagattcggcacttgggcctccttggtctttttgactctggaggaatccttccggcgcgtcgaaagacaagatgtgagcccgtttaataaatttttatcttgaacttatcagatgtgtctcaaaaaaccaccctgaacatctcaacttggttgagactcctttctcctgtgattttactttatatgatgcgtttcagctaccctgaacatctcaacttggttgagacggctatccaaaattcctgtttctttaaccgaagatggaggtgtatttccgcgaaccctttcttgaagggcaattattctgttagcctcttttgaccgtgtgattctaacagtctgaagttcctataaattttgaaaacgcggaccttcccgctttctcacaccgttgctcgttcgcgttcaaggcaaaacaccaatgaataagttcttttaggtaagaaaaaatattatggcaatccccatagaccctaagcaaatcgtttcctttgaagaactcctcatgtcccaagtcatccagcaggaggctcttacaagattgcttgtggaaaaggggatattcagcaaggggggggtttggagacggtgagggtggcgaagaaagcaatcgagaaagacccagaggtctatagtatatattataaacccgaagggaaaggacatggtatcgggcagacaggcatttccaacttcctcggtggtgcatggaaacggccttatcaatctcgccttattattaaagccagccattaaagagaaggcaaggactcttcagggaactcggacagacctttctcttgggaaagggaagggtagtgcctcttcccaaaagccactaaagcatgaacgtttgggattacctgtcaaacgtatgcaacacgctcaaaccatttctcgccatcccgaaattgtgaagaaggcaaaagcgcatcagggaactcggacagacctttcgttgaattcatcgaaaggttctattgatactcgcaaggaagtagcgaaggctgcagacggatgatggtgcgataagttccaggaatcaaatgtatcaccgtgttacatttctcttctgtcctgcctgtcgcaggcagacgcagggcctcaccccctcccatcgagggaggggtaagggtgggggctggtcccatccataggggaggatagagaaaagagtttgtagcgcatcctgagcatgattactttaggtgcctaaaggcgatattattcgatagcaaaccatatcactcctcaacatgtaagactctattatcata

SEQ ID NO: 99 - DNA, 22198 bp, synthetic construct
  misc_feature 1..22198: note = Synthetic
  source 1..22198: mol_type = other DNA
ctcttccccggttgccttttcgtctgccgccgaagtaggcctcatccagctcgatttctcctcccaggaggtctttggcatcttcagcatggctcaagatacacatgcggatggtgttcacggcgccatatacggccttataagacattttcatctgcctggccatcttgtggaccgatatttcaagctcaaagagcttgatgagagacagccattgaatacagctcagacgcccatggttgatccagcggccggagaagtcacggaatgtgtaaaagcatctggagcaacgatatcttccgtcttctaacttgtaaagttttctcatgcgacaacgaggacagaatctctgatggttatggaagcattttcccaacagatatcttctggccttgctctcgcttgagattaagtcatagtaagtatttaagtccatatggcacccttatcacaggtgccagaacggtatcaattaccaaaaattttcctgttgatttttcatttgatcaaaatcattgcctaagtcggataaatgatgaagcattgtgaagcctatctgtcaaaatatgaaatcatggaaaatctcggcatcttctgtgcctttatactcggaattaaaacataaaagaagcagggtgcaaaatgatacgccttggctgtttttgtcacaacaacagatatctttgacggattccatgaattgactatttacaggagggaataatggaattaaaaggggttatagaaaagtttcggtttattctggatcattccatcgacgaaatttgcattgttgacgataagggaattataatttatatgaatgctgcctgtctgaaacattacggcaaagatccttcgtattttgtcggccatccagcaacgcgcgccgaagtagaaggagtcgttgatcatgcaatcactcccttagtcttcaaagaaaagaagaaagtaaccattatccagaaaacagccatcggacgggatttgctcatcacggctaatccagtctttgatgagtcagggaatattatcctgattatagaaaatgtgcgagatatttctgaaataagagatcttcaaaaaaaactggaggaaactgaaaacttagttaaacgttattcggaaaaactggaatcgctgaaaaaagaacagcccaagtttgaagggatggtaatcaatagtgccaagctgaaaaatatcatagaaatgatagaaagaatcgcaataaccgattcaacggtcatgatccttggagaatcgggaaccggcaaagatgaaatcgctaaaataatccattcattgagcaaaagaaacgaagagtcttttgtcaaggtgaactgcggtgccataccttcaaccctcatagagtcagaattattcggttacgagggtggcgcctttacgggatcaaaaagaacagggaaaaggggtctaatggaatctgccagtgggggaacgttattcctggacgaagtaacagaacttccatttgatacacaagttaaactactccaagcactccaggaccgtcaattcattaaagtgggcggaacccatcctgttctggcggattttcgattaattacagcaactaatagaaatattgataaactggtaaaggaaggcaaatttcgggaagatctcttctatcggttatacgtaatcccgattgaagtccctcctctgcgagaacgaaaggatgaaattatacccctgttacagtactatgtcgattattttaataaaaagtaccatgtcgataaaagcttttcattccaggctgtatcgctgctccgtcactatgactggccgggcaatatccgtcagctaaagaatgttgtggaacgtctcgttgtcacagaaacggaggacataatctcgtacaaatcggtgctgtccgcagtcgggaatacagaagagatcctgcatataaacaacaaaacaaccctgagagatctcatcgaggatcttgagaaagaaatgatcatccaatgttataacgaacacaaatcaagttacaaagtggcggccctattgggccttagtcagcgcacggccctcagaagaataaacaaatacattggctccatgcgcacccaaaaatagaacaaatattagcaggaaaatacctcctgacttttggaagcaatcaaaaatacaagaggtcgatatgatcaccgaccaggagaagcttataaggtgtttttcgatttctacccgtaagatttattctcgtttgagattaagtcataatgagatgttagaaccattctggcatcaccatggcaggaggtgcaagaatggtatcaatgaaccagtttaaataatccctttttccgtaaattcctcgatctttttctgatcaattccaatcgatcttagtatttccacattgtgctgacctaaaagtggtgctgatgatgtcactctgcccggcgtcccgaacatcttaatcggaacgcctggtactctgataatgccaagtagaggatcttcaacatcaatgatcatttcacgggctttcgtattagggtggttaaccacctcttcaatattaaggacgggcgcgtgaggtattcccgctggtttaagaatttcctctaattctgctattgtatatcttgctgtccactccacaaaaattggtttaagcttagtaaaatagttttccactcggagacgcgtagtacggagctcagagtcatctatcagttcctctttacccatggttctgcacagattttcccaaagcttctggtttgctgcagcgattacgatatatccatctttgcattcgtacatatcgaatggtgcggtataaggatcaatattaccaacgcggccgtttatttggccatttaatgtatattggataatggctgcttcgagaatcgatacaatcgtgtcggtcatggccacttcaagttgctgaccatatccagttttttcacgacgatatagtgccatggaaataccaagggcaagataggtaccagtgaaattatcgccaatggcagggccgaccttaacaggtgggctgttcggggaccccgtaatgctcattattcctcctaatgcctgagcaatattgtcatatgccggtcgatcacaaagggggccataagatccgaaacccgaactagaggcatagatgatttttggattgatatttctcagtgtttcgtatcctatgccaagtttttccatggttccaggcttaaaattgttgaccacggcgtcagccgtcttgaccaactccttaaaaatgaattttccttcttctgtttttagattaatagttattccttttttattacgattcaggaaagcatgatacccgcttgcatcatttttaaaaggaggccactgccgcacttgatcacccaatcccggatgttcgatcttgattacttctgcaccatgatctgccaggttcatggtgcagaatggaccattatatgcgatggtcagatcaaggaccctgatcccctcaagggatccgaagggtgttttattttcacgatcgcttattttaatttcttcttgactcatctacattcctccctttttcatgtaaaataataaaagtttggttgcttgattagcaatctatgtgccacctgattaactcactgattcctttattaagagcgactgttttttaaagacttcaacttttaaattcgatgtaatatcggctcattccatgaatatgtaaaaataacggaatttgatgttaagtggggcaaagaaattgtgttcaagttttttgaaaacaaaagactggcgtatggattgtaaacagggaaagctgaggaagcacatcataaataagccatcatggcttatttattttataagtaagatttagatgacaggaatacaatgtaaaatagtaatttacagttgagcttatttgtacaagccatcatggcttatgctttttgtaatcttatttctaattttcattatgacccgcgagtcactgaattttaaacaagccattatggcttgcttaaataaagctaataatttttacataaattaacttatggattaatcctgcaattcctgctttgcatttccattgaataatcgaagcgtttcagtgttgctttgccatttagacagctgcccaccttgaaaatcttttaaaaaatctctttttcgcatgttgatcttcgttctttcatgaccttgccagactaaatagctttttcttgttatttgttaaacatattcaacgtgtgtccaatatagtagcgggatcataatataatggcaccttaattgcagaaaggttgctgaaagacaattgtattccctgtaccaagagttttaagtgtcgactcgattaaaatactttaaggaggaaatatgattcaggattatgtagaagaaaacacaggctggatagttctcaataatacgaggagaaagaacgccctcaataacaaaatgtataaaagcattttagcgcttactgaaaagtatgaacaggatgaaacaattcgaaccattgttttgaaaggaaatggtgacaatttttcagctggttacgacctctctcaaggattacccgatccatatcgaaattttgtgaaaaatatatccggtcctaccttatggaaactctggtattgcagaaaaccaacaatatccatgattgacggatattgcgttggtggaggattcgaactggctatggcatcagacctggtttatgcatcagatgatgcttctttgggagagcctgaaatagatttctttttcactccagattttaacacgattccctgtttcatccttcctcgaaaagccaaggaaatgatttttttgggaaccgttatatcgggaacggaagctgcaaaaatcggattaataaacaattcgtttccaaaagatattctagaaacagaagtaaagaaggtatgcagcagaattgccagtttacctgcagaaaccattgaagtggcgaaaacaggtttaaacggagctttagatttattaggttttagaaatgctgtcatttatggagaagaaatggccatttataatggccttctgagtaaaacaaatccaaaatgtgcacccttttatgaaactgcaaaagagaaaggagtcaaaagcgcaataaacatgatgcgagattatagtcaatccgggatttctgatcaagacggctggaaaaaaagttaaaatacggggataggagggcaagattatgattttaggcgttccgactttgacatttctctttatgttggcatttcctgttaccacaatcgttttatcactgatctacgtgttttggtactatgagaagattgagcgtcctgatgaagacatcaaattcgattagaaaacaccaatgaacaaaatgcagaattttaaggaggaaggagtatggaaggagcgggagttgaacttgcaatggcaaaagggtggcaaaccggtatggttgtcattatttatatattggtactgctggccattggaatatacgtttcccgaggaatgaaaagcgcaaaagacttttttattggtggcgcttcaatcggaccatggtttgtagcgttttcagctgcggcaagttttatgagcggctggggattcgtcggaggaccagggcaaatctatcaaaatggatacagccctatgctggtattggaactttttgctcttatcggcatgggactcagttatttccttgttgctgtaccgatacgaaagatggtgaaccagtataagatccttacaatcccagacgcaattcgggcaagattcagcaatgaaagagccgctaaagttattgcccttggtatttttatcggtgtcttcccatatatgctggcccagtatctcgccatgggatatatcggtcaaaccgtcttcgggttcgaattctggcagggctgcctgatcggtgttgtcattatgatcgcatattcaaccctgggcggcatcaaggcatcaatatacagtgaatttttacaagcatctcttatgtgtgtaggtgctgtggccatgttgattatgggacttaaagtctgtgggggatggacaaactgtttttccactctttcgagtattccagagtatatggatatattcaagagcagcttccaaggtggtggtagtgcctggggcatgctgtcatgggcgcttatgttcgggcttggtgtttcatctgcccctcacgttatctcccgcttttatgcgattaaaaaagccagctatttgaaacaggccttggtcgtctccctcgtagttctattattgtttgattttgctgagtggtcagggttctggatgagatatttagttgaggtcggaacggtgccacctttatcaaaacctgacctcgctgggccaacttttgtcatgtttacattcggttcagtcggggctggattaatggtaggtgctattttatcaggcatcatgtcaacggttaactccttcatggtgactgccacatcgactgtaatccgtgactttatcaccccatatttgaaaaagcaggggagagtgttgacagcaaaacaggaactctatatctcacggtatggaatggttgtcgtggcactaattccccttcccttcatatttaatccgccccagcttctcatgtggattgccgcggcggcatggggaatctgggtggcaacaatatttccgcccctggtctttacccttcggtggaagagaaccacaagcaacggcgttttctggggtgcgactatggggcttagctcgagtctcctattgagccttctgaaagaattcgccaatattcataccgtaatcgaacctggagcctggggtatgataattggctgtacttcactgatcgtcgtttcccttgttggggttaaggaaaaagaaacacatcaaattattgatacgatatcggagtcagtcagtgagattagacctttgccaatgagaccagaacctgttgctgtcgtagttccatattcagaaaaataaaatatgctctagagggtgtgaagaaccgatacgttgattatagtgttctctaaatatccggaagaactcatgataaaaaactgtgaggtcttccggatataattgtgtaagtgaaataatacgatcaagaaagtggtgtaagaggacgttcacaatttcaggtattgtaggaggcatcgatatctcctaaaatggtgcttgctgaaacactaaaaaaaggagacagagtgatagccaaagctggattaccgaatatagtcttcaatcctcgcgagaattgcagccatgagtattacaggaagatagacgtaacaaaagctgcctttacccccccgcagaaccgcctcatttgccctacaatcaattctctcaatcacagggcatgaagaccttcaccctgatgaacatttttggaattagctcctatttgatgaacagtccaaccgactgaccatatcataccgaaatatttaatcaattacgaattatcctcttgactttccgtaaagacggcatcaaaataggatcatcgacattacgttcatcattgaggtaaccaagatgaccaactcaatacaaaatacgccttttcttttgagttcggcccatttaagtgcccaagatgacggtttttccgtcccaaaggatatcagaaactcaatagaaaactttgtgaaagagaaaggaggtagcggatgaagtcgaaaggctcagaaaacatcgtggcttttccttttgcgggagagcagaagaagcagaggaaaaagcgcacgaaaaagaccgttgacaggatcaagtatttcaatgtctcacagatacgccttttgagaagggctgcaagggaacaggcggaaatggatttctcgaaaggccgcattgccggtattcgggaatggatggtgatcgacctcctcacctcgacgggactcagggtatccgaagcagccaacctgagatgtggagacttaaagatcggatacggggaaagcaggctctttgtccgtgaagggaaaggagacatttccggtcatatcgtgatcaacgaatccctgaaaaagcatctgaagagttttctccggtggaaggaggagagaaacgagaagaccgggaatgacgatcccctctttgtcgggcagcgtggcccctggacagctcaggccattcagcagatcgtgaaaaaatacctgaaggatctcaacctttacgaaaaggggaagtccgtccacgccctcaggcactcctacgccgtggagctttattcccgtgggaaggatctcaggacggttcagaaacagctaagacacgtttcaattcaatccacccttgtctacgccgatgttaccgacgaaacgataggggaacagataaaggggctgtggaactgataggaggggcatacaatgacggataagaagaaaagagacactagggcaaggggtccacagaaagaacaggatcagctgaagggaagcgagaacaaaccggacaggctgaacatcggcataaaggtggacagatccctgtggagacggttccgtgccgttgcgatcaggaaagacgtaaacgccggggatctcctcgacagggtcattgaagactacctgaaggagcatgaatacgaaaaataggagaagaatgaatgggaacacaggaagtgctgtcaaacattgaaacagccatcaaccgcgtctgcaaggacatcaccgggaagaagggaatgacgggaggggataagctcgactcattgtcgaagctcgtcaactcatacagcaggctccttgaaaggggccagaacgtctcccagaggaaggacgaggaggaaggcgatcccgactactacaaaaaccagagccagcaaacagttgagaggagagggctgatccggtaaaggggtctcccccttttgtagcaagcagactcttcaaaaaaacgtctttttaaacgacaaaaccccgccaccaacaagcagaaaaatcaaacatactacataatccgtagcactcccaatgacatgagacggttttgtcgagtgacctacccccccccctcgactaatccgtcgcattcaacggtttttgtagagtggatacttgaccacaaattttttcccaagattttcaaagagaaatattttattgcaatttcaaatagctttttttaaacataagtcatccatcgttattatatttgttttccagtcagtagatagaatacgacttagagtcaaagaggatttcaatatcaaagaggaaatatttgtaaaaattttaaaaaatgcgcctaaagcctttcccaagtattttatagtaaaaacgattttttcaggtgcaatgagtttatccgtcaacaggacaggacaatgaagaaatgataactctcggcatagactacggagcctccaatataggaatcgccttggtcctgacaaccgaggctggtgaaaatattcctttgtttgcagggactctcagagttgatgcgaggcatctgaaagagaaggtcgagacccgggcaggtatcaggcggctccgaagaaccagaaagacaaaaaaacgacgtctcaggaaccttcagcacgcccttgaatccctcggattatctccggaccaaacctcaaaaataatcagattcagcaagagaagagggtataaatcgcttttcgacaaggacacccctgatgaaacgaaggatgacagcgagttaacctaccgcttcacccgtgaggaattttttaaatcccttgaaaaagagttatccgaatggatttcagatgaagtaaagcgagcaaaggccctctctatctgtgaaaaaatacttaaccgccatggcaaccgggaccatgagatcagaaaactccgtattgataatcggggagtgagccggtgtgcctgggaaggatgcagggccgtaacacctcggttggaaaacgcactcaaagaagccctgtcacagcagctatatacggtatttcaaacgctggtcagagaaaatacagccatcaggaacgaaatagacgaagctgtagccaatctgacagagctggcaaagcggctccgtaatgccagcggtgatgacgccaattcagaaaaaaagatccttcggaaaaaagctcgttccgtactgaggcatttgcgagacaggttctttgcgcttgatgaacccggccttgagaaagataaagcatggaaatatattgaatcgtcgttgatgaacactctggagaacaggggtggaagaaatcgatactgccgttttcatagcaatgaatatatcaatacgatcctccagggaaaaccggtcccgttcaagaaaacaatagctgactcggatatcatctcaagacgggaacaaatcgcttacgcaaagatttggcgttatatagaagcccgccttcttcctcttgcacctgaagggattgatcgcatcgttgtggagaggacggctttcgatctcctcgccggaagttggaaaagtattgcggatgccaccgatgccttcaaggaggatatgtatcagcagggaccgatgtacggtttcagttccagaggagagatgctccgtgaggagttcgggggactttgtgcttactgcggattgccttcatcggttctcatggacagagaccacattcttccccgggcggatttcttttttgacagttatcttaatatcgtcccggcctgtccaaaatgtaattcggcgttaaaaggcagacgaccggcttctgagatagcattgacaattcatcccgatgcctacaatgcctatgatcattatctcagaagtaaatttaaaaaaaggcccatgcacttcttccacacaatcaaaaaaggcatcctcaatctcatgaaagaccctgaccgcctttgggaggctgaacgttacctttctttgattaccaaacagttcagccagattgtccagacacaaagaagccccaggccattcgcaagatatttgtcctcaaaaattgggacgcttcaaggcaaaaccccggagatccgcttcagaaacggccgccatacagcactctatcggaatgttgcctatcctgaatttgacaaatatcgagaaaaagcggaaggaaacgcaatcaatcacgccctggatgccatgttgttggcttcagaactgcccgacctttatcccgtggagtcattgaatataccgttaagcagtttgaaggcatggtcagcgtctgtgaagagaaaggccccgaagccttcagcagacggcattccgagcatccagaatcttaatgattttgttgatggctttgaagtagttcatggagacggctatgtcgatgttgcattgagaaccatggtctggaatcaaagagacacgatgacccacaaacaggatccctacggatggtctgcaaaagacaaaaggcccaccaagaggacttcggcacttgacctgtacacagaactcaaaaaagagaaggccggcaaggtaaagaacaaagtcgaattgattcatcacccgtcattgagaaaagccgtttcggatgccgtgactcccgaaaatccgggaggaacggctgcagaggcgttaaaattatggctgtgtaactcggtcagaaataccttaaagacatcccatttttcaaatcatccaggcgatcgggcacgaaaagaggccctggaaaaatttgcgagcaatgaaaacgaaacgatcccagcggtcatcggtgtcaaaatgtttgacctgggtgttcagggaaagatcgatttggagagattggacaggcagacgggcaacgttggccacagatacatgacacaaccacccaataggggggtgattgtagcatatccgaaagcgagtgatgggcatccggatatggcccgtccctgctgtctttacttaagacagaacggtgcggttattccggaaggactcgccattttcaaaccacttcccgacaaattatcaaaaggtcggatctttggttcccataataacgaggtaagcactttgtttcgtgatgtcgaagattacctgaaggattgcggctttttcggctacattttattaacgccgggttgcgttgcccattacgctgatggccattcttggttcgtcaggaactttgatcaaagtaaggatttcaagaaattccgattgagaaatattgtggctataaggaaaacacccttttcccaaaagttgataccgcaaaaggtattgacctgaagaaaggagggtgttacacatttttcaggttgttctttgacaattcagattctcaattatcggtccggttgaaaagagcatcggtctgaaggatgcactccgggatagggcagtcccggctcttgctgtttccccggtaagacctcggaagcaagtccttcagcaagtcgaaagacacgatgtgagcctattttttaaatgtgaatcaaccgatatcttcacattcattgtgacacggtgagatgatgacccgccagaaggccaaaatgtttcaatcaaccgatatcttcacattcattgtgacggaatccatcgggcccggatcacatccttatatccgtccagaccacccaaatgttcaaagtttcaatcaaccgatatcttcacattcattgtgacgacgatctgcctgcttaactccgatgtcatactggtttcaatcaaccgatatcttcacattcattgtgactccgtaatggtatcaatgattgttgacgctctggtttcaatcaaccgatatcttcacattcattgtgacacggtgagatgatgacccgccagaaggccaaaatgtttcaatcaaccgatatcttcacattcattgtgacgggccgacaccctgaaatacgcccaggagaactttgtttcaatcaaccgatatcttcacattcattgtgaccttgatgccctacggacatcagcaattcgaccctgtttcaatcaaccgatatcttcacattcattgtgacagcggatctgaattgtcaaagaaaaacctatccttaagaggcgttttccgcgaacctctctggtaacttccaaagtttgatcatttttccattttacagacgcttgggtacgaattaagtattcaatattacatacaatattgatttccgcgaacatccaagtagccaaaaaaggaaaaactttgtattcatttccttttcctccattcccacgacggcataccgtgagagtcactccgtagtcacattttccattccgaactcatcttcttatttgatccaatgactttctttggaattatcgtaaaagggtagcaatagggtagcagaaaatgataaggggttacgatacatgagtcgtaaccccttgttatttctggtacgcctgctgtgattcgaacacaggacccacggattagaagtccgttgctctatccagctgagctacaggcgcacgagctgtgtcacacgactttaaggagttgaaattaatagcccctttaaacttccttgtcaaggcaaaacaaatattgggaaaacatgtgcactacagggcggtggggtcaagcctgaaggtcgcgggttggcgagaaataatgacgagaaattcgagaaataatgattgacgaacacgccgagcttccataatataaggcgtgcatggatatataacgaattgaaacgcttgcgttcttcgttttcagcgaaattttttaattagctttttccctgggatatgttcaaggaggtggaccgtgcgcgtaagagtggcgatcaatggattcggtcgtgtgggacggtatcttgttcgggcctgcgtggacagggaggatatggagatcatggccatcaactcccgggccaacccggaaattctggcccatcttctccggtatgattcggttcacggcccgttttcgggaaaggtggaggtaaaggattcctctttgatcgtgaacggccgtgaaatcatgattacgtccctgacgggcgacccgggcgctctgccctggggggacatgggtgtggatatcgttttcgaatcgacgggcaaattccgcaagcgcgccgaatgcgccggccacatcgatgcgggggcgaaaaaggtgatcatcgcggcacccggcaagggagtcgacggcacgttcgtcatgggtgtgaacgaagcgtcttatgacccggagaaacatcacatcgtttccaacgcctcgtgcacgacaaactgtctggccccggtggtcaaggtgctccacgattctttcaaggtcacccgggggttcatgaccaccgtccacgcctataccatggatcagcgtcttctcgacgggtctcacaaggatcttcgaagggcccgggcagcggccatgtccatcgttcccacgacaacgggggcggcccgtgcggtcacggaggtcatccccgagctgaagggcaggatggatggtgtcgccctccgggtccccacgccgaatgtttccgtcgtcgattttgtggcggaggtgggccggaacgtcacgatcgctgaagtcaacgacgccctcaaggcggcggccaacggaccgctgaagggttacatggcgttttgcgaggaagagcttgtttcagtcgatttcacgagcagtccttattcctccatagtggatgccccgttgacgaatgtcatcgacgggaacctggtaaaggtattttcctggtacgacaacgaaagcgggtatgcctgccggatgagagacctggcccttttcatggggaaaaagatgaccggtaagtaaatggaaaagcctgtttttgccgcaaactggaagatgcacaaaaccatcggggaggctgtttcgttcgcccggaagctgaccgagtccatcggatccctttcagaccgggaggtccttctggcgccgccctacaccgctctttccgccgtttcccttgcctgcagggattccgccgtttcccttgccggccagaacatgcactgggaggaaaaaggggccttcacgggcgaaatttccccgaacatgcttctcgatgtcggctgtacgtgggtcatcctcggccactcggaaaggcgtcatcttttcggggaaagcgacgtaatggtgaatgacaaggtaaaagccgccctgaaacaccacctgaagcctctggtctgcatcggggagaccctggaggaacgggagcgggagaggaccttcgccgttgtcggaaaacagttgacggggggattgaataatatttctcccggtgatataaaggcgctcacaatagcctatgagcccgtttgggccatcggaacgggaaagacggcaacgcctgacgaagcccaggaggttcaccgttttatccggaaacagctccgtgaactttacggcgcggaggccgcccggtccgtgagaattttatacggcggaagtgtcaaggaatcgaacataaaagaactcatgggcatgcccgatatccagggggttctggtgggcggggccagcctggacgttgattctttcctgaatattgcccggtgcccattacaataacagtaaggagatagaaggtcttgctcattcttgttacagtcattcatgtaattatctgtcttctgctcatcatgatcgttctcctgcagagcggtcgcggggcggacatgggggcggctttcggcggttccagccagaccattttcggcagcagcggcccgacgacttttctgggtaagatgacgacggtcatcgccaccgtttttatgctcacgtccttgtggctcgcctatgtcgccgttcacaaggttccctcggtgatggagggtgtggcggttccttccgcggtggagcagaccctgccgccgacggaaagcggacaagaagaaggggctcccgcggcggtacccgctcagccggcacaaccggttgaaacgggtagcgaaaacgctggtggaacgaagtagcggatcgggaggttttccgcgttcccgctcacttttgtattgacaaaaaccgtaaaagaaaatagacttttcacgcaaatgccgaagtggtggaatttggtagacacgctatcttgagggggtagtggggaagcccgtccgggttcaagtcccggcttcggcaccattctataaaacaatatccttcgtgattgtggggaattggaactaagtccaattccccacaatgcgtttcaggggtcttttggggtgatcccatccctcctgactttaccttggcatcccccgttccgataccggtgccgggccttgtggacagcgggcatggctgaaacgtgtcacgcggggtcttgcctcattttttttctctaaatccacgttagttgaggtatcactcacagtggaagaccttcacgacccttctggtccccgagaaggcgggtccaggggaacagcctcgtcgatgagcatgacggggatgtcgtcctcgatcctgtagagaagacggcagtgatgacagatgaggccgtctttttggtcgctgaggacgatgtcgcccttgcacctggggcatgccaggatgtccaggagttctttcctgatggccatcgttttcattctccttttgccgctggtttcaaaagggagcggcccctcttctttgttttccccggcaatctacccttcgccgaaagtttgaccgcgtcgaaaacttcctgaacggtgatctccctcatgcagtccatgcggtcgcactttttgagaaagcaggggctgcaggggaggttcttcctgatgacagtgtggttttcgccgaggggacccgtcctgatcgggtcggtgggtccgaaaagggcaatcgtcggggttcccacggcggcggccagatgcatgggccccgagtcggtcgtgatcaccagggccgaccgccggtaaagggaggccaggtccttcagtgtcgtttggccccccaggttgaccgaccgggggcagagggccttgatgtcctcaaggataccgtcggaccggctacccgtgagaacgacgggaacgttcatctcttccgtgattcggcggcagagttccccgaatttttcactgtcccagagcttggttttccagtaggcgacgggattgagggcgaaaaaaggggttccgggaaccagtcccgactgccggaggagctggtccacccgggtccggttgccttcgtcctcgggaatatcgaaacggggatttcggggatcgccgcccaggtgggaaacaaagtcgaggtatctcaggacggcatgctttcccatgtcctcgtatatcttttcattgtagaaaaggccgctcagttcctggaggctggcgtatccgacccggcgttttcccgaggatagaaaaacgagaaccgcgcttttcaaaaggccgtgaaaatcgatgaccaggtcgtagcgccggtcccgcaagtcgcccagaaatgttttaatgtctctcagcgtttccggaaggtgtcgtcctttccggatgtgggaggcccaggtttttctccgggacacgatgacccggtccaggcagggatggcccgccagaaggtccgaagccccctcttccacgacccaggtgatgtgggcctcggggtaaagctttctcagcgcggccagggagggaagggtgtggatgacatccccgatggcgctcagcttgacgatgaggatattcatgattccctatcccggatccaccggacggcgtcgaggacatcgtcggccctgtaaaggacccggtcggcccggtggatgttgacaccgtaacccgtccggaccaggatgccaccggcgccggcatgtcgggccgcctccatgtccttcagcatgtcgccgatcatgtaggaccggtgaaggtcgatggccaggtcggcggcggccctgaagaaaagccccggtttcggctttctgcagtcgcagtcctttctgtaggggggggtaccgaaatttgggtgatgggggcagtagtaaaaggcgtcgatccgcgttccttccttttccagcctcgcgtttatttccccgtgcacttcgtgaaggaacccctcgtcgaaaaaccctcgggccacgccggactggttcgtcaacaccacggctttccgtcccatttcatggatgagggcgacggcctccgccgtcccgggaaagagcttcagctggtccagccggctcagatagccgacttcctcgtggatcgtcccgtcccggtcaagaaataccgcgccgttcccgctcatgccggatagtcctcctcatggctcagcagggaggacgacgcctcgtacacgtcttcctccgtgatttctttcatgcaccggaaatcggtggggcaggtttttttcaggcaggggctgcaggagacgttcttcgtgatgaccacgcttttttcccccacgggagaggtggtccggggattggtggatccgaaaacggcgaccagcgggaccccgaaggcccccgccaggtgcatgagacccgagtcgttggagaggaagagccggcagcgggaaatgactgccatcgcctctctcagggatgtcgagcccgccaggttgatcatggaatgccgcccggccccggccacccgttcggccacggccctgtccgccccgctgccgaaaaggacggtcctgagaccgtattcgtcggtgagacggtccgccacggcggcgtaccgttcggcgaaccacatctttgcaggtccgtaggtcgccccgggggcgatgcccagcaggggcatctccccggtcatgccatgggcccgaagaatctcacgggttgcggcacccgtgtcctgtcccgggaaaagccggaccgccgggccggcgtcacggccgcccagggccttgatcatttccaggtaatagtggatctggtgacgtttcaggatcgccttttcccgttttaccgggtgggtcagaagcagccttcttccgtcggtgccgtatcccgcccggatgggaattccggcgaggcgggcgatgagggccgcctcgaaggcgttctggagaagaacggccgcctgaaagtctttctttgcgagagatcgggcgagccgccattttcccgggaggccttcatggatgcccggggcttcataaatcatgacctcgtccacgtcagggcaaaggtcgaagagatcggccacccagggtttcacgagaacggtgatccgggcccgtggggcgcttttgcggatggcccggagggccggaagggtcatgaccacatccccgatccagttcgttccgcggacgagaatccgctccagatcggcgaagggaacggtcctggggggcgtccgtttcaccatgccttgacctcgtaaggctttgtcttccagcgctggtgcggccagaaccactggtcggggtattggcggatgaacccttccaggtaggatgtgaaggcctgggtgttttccacgaggtctcgctcccggtcgcctgtccgggtgacggggatctccggccccatgatgacgtgataggcgccgtcggcctgccggacgttgatgacggggacgacagcggtgcccgtttccagggcgaaacccgccacaccccgggtcgttgcggcggggcgtccgaagaaattcacgaagaccccttcacgccaggcgacgttctggtccatgaggatggccaccgcctggttgttcctgagaagcgaccggatggattccgatgcgccacccttcgggatcatccggtgtcccgtgatgctccggaaccagaggaccacattttccagcacggggttgtcgaggcggcggtagacgatgttggcgtgaatgcccacgaagccgatggccaccgacatgagttcccagttgcccagatggccggtgaaaaagaggcagcctttccccctggacagggcgttctcgtagtgttcccggcctgtgaatatcaccccgggggggagctcgcccggccggtaggtcgggatttcgaagaattcggccgccacggtgcctatgttccggaagacgtttctcccgatccgggaaatttcaccggtttttttttcgggaaaagcccgcaggagattgtggagggtgatgagccggtgccgcggggaaaatcggtaataaaggagaaagagggcccggaaaaattttttccgcgccggcaggggtaaaacccggaaggtgacgagaatgaatcgggtcgaacgggtcatggtcacgatgacagaacccccaggatcaggtcttcaaaggcctcgtttccgtcatcgagggtcatgacgatccggagacggtggaattcttcgtggaaatcgggaaatttttccagtttgacgccgtccttttccgtggtgacgaggacggcaccgggaacgcggccggcgacccggcggagccggtccacatcttcccgggtgtaccggtgatggtccggaaacgtcacgcaggccggggcgtttccagaaatttcgttcagcatcctgtgaaaggaccggggggcggcgatccccgaaaaagccaccaggggtttccccctgaaatccgccagggggcggcggttgttttccctcccgcggatgaaggattccgctttccgacgggcccggaatagaggtttttcactgggaatccggggatcggcggccgccggtgcccctcccgtttccccggctcctgtcagaatgatggcgtccgcccgggagagactttccgggggctcccggagtatcccccgggggagcagatggccgttgccgaagggggcgttctcgtccatgagaagaatgtcgaggtcccgcccgatctttcggtgctggaacccgtcgtcgaggagcagaatgtccggccggaatcttttgagggcttcgtatcccgcctcgacccgctttgccccggtgacgacggggacgttccccaggacccgggccatgagatacggctcgtcccccgccctgtccgggtcgaggaggaccgcctttccgtcggaaacgatgttcacccggctcgccccacggcttccgtagccccggcttatcaccgccggccggtttccctgtttctggtagaaacgggcgagatggaggatcatgggcgttttgcccgttccccccgtggtgatattccccacgcacaccaccgggaggggaagcctcaccggttggaggattttcctgtcataaaggcggttccgataccggacggttccctcgtaaaggagagagaggccatggagcagggtcgtcagggaccgggtaggcgaaccgccctttccgggggaggcggtcgccgggatgccatggtctttccatacctgtcgtctcatgcttcgaacagccttttctcccgctttttcagattcccgccgcaaggccttctttcggttcccggaactggagggtgtaaaggcggctgtactcgccttccttcaggaggagttcctcgtgggttccttcctcgacgatgcggcccccggcgagaacgcagatcctgtcggcatgctggatggtggacaaccggtgggcgatgaccagggtcgtccggccccgcatgaggttgtctatggctacctggacttccctttccgattccgtgtccagggaggaggtggcttcgtcgaggatgaggacaggggcgtccctcaggatggcccgggcgatggtgagccgctgccgttcccccccggaaagacggaccccctgctcgccgatcatggtgtcgtatcctccgggaagctgttcgatgaagtgatgggcgtttgccgcccgggccgcctcgatgacggcggcgtcgtctttcccgatatccccgtatgcgatgttgtttctcaccgtgtcgttgaacaggatggtctgctgggtcaccatggcgatctgggcccttagggattccagggtcaccgcacggatgtccaggccgtccaggaggatccggccctcggtgatgtcatagaaccggggtatgagattggccagggtcgtcttgccggcaccgctggatcccacgaaggccacgatttcaccgggccggatggccaggttgatgtttttcaggaccggggcttcctcgtatcggaaggaaacgttttccaggcggatctcccccctgacgggaggcagggggacggctctttcggcattcgcgatgtccggctccatgtcgagaatttcgaagacccgggtggcgccggcgattccctgctgtatcgtgttgttcacgttggtgaggcgtttcaccggctcgtaaagcatgatgagggccgtgaggaaggaaaagaacgttcccggtgtggaagtgccctggatgacctggtaac

SEQ ID NO: 100 - DNA, 22198 bp, synthetic construct; identical to SEQ ID NO: 99
  misc_feature 1..22198: note = Synthetic
  source 1..22198: mol_type = other DNA

SEQ ID NO: 101 - DNA, 19310 bp, Syntrophaceae bacterium
  misc_feature 4594..4595: note = n is a, c, g, or t
  misc_feature 14253..14254: note = n is a, c, g, or t
  source 1..19310: mol_type = other DNA
ctgcccttgcccttcgcaacggttttacttggaaaaggccgccgtggggacgggcaatcgcaacggccttgtcgacaatttccgcccgaatcaccaggggaatggcgcgaagcgccgcaatggtctcaccctccttcactggaaaattggtatgacgggaggcacacatcacctcttccaggaggttgatctcggttaacgcttctacattcgctttaaaaagaccgtcttgcgccgcgaccagattgatcttgccttcctttggttccccctgccaggtgacgccgttgccaccaaacgcattggccatggcaacggcggcatcgttttcgtggaggtacccctcctcgatctcaagggcaaataggtggcgcttcccgagcctctgtaaatgacagatgtcggactcacgaaccttgtggccttttctgaatgccggacctttgaactcacctctgcggatttcagtgatatcgtgggcaaggatcgctcccacggcgtcttcgatatttattaccctttggctcatttcagttcgtaatacccctttccctggcaggcgaggcagccgtcaacccaccctttgagaactgccggcaatccgaaccaccatagtgggaactgccagatcatcaactcacactactcgatcttgctgatctcggactcaatctcctccgaaaacccattcatttcgcttgcgtacatttcttcgatctgtaatttgaggtagtccgggtctttgatggttgtaaagttcttccggctggaaaccggctcgaattgcatctcatgcaggtctgaacttcttacttcgtgccctgctgcggtaagcgtctcgtgcgcagtgcaaaacatcgcagcgttaaagctttggggttcgggatgccaataaacgatgaatgctttcataaatgacctttcctgttcaacattgcttatatggatcggtataaaatctcaaacaccacaatatttaccgttcattcgagtgcacttaacagtctgactctgttttgttgccggcggagttaaagagggatgcgcatgcccggtagtcggagggggtatcgatgtcgctgatcacttccgtccggtctacggccacccggagcacgtctgccgggtgatcgtacaagagacgccgcacgccgtcattggcgaacccgagaatctcattccggtatttcagtgcgaacacgatcggatgtcctttacgcccccggcaggtggggactgcaattcctttttcgctttgcaggaatgcggccaaaaccagatcgatggtggcagtttggatcagcggctggtcacccggaataagcatcaccgcttcggcacccaagtcgacagctcctattccggcgagcgccgaggtcaacattccttcccggtaatggggattcgtgaccagccggacgggcatgccccgcagtcgggcggcgatggcttccgcctcgcagccgactacgaccaccacttccgcgaccgccgagttgatcacgtttcggaccgtgcactcgatgatcgtgctgccgccaagcgggaggagaagcttgggttctcccatgcgcctggactccccggcagcgaggataactgcggataccgctcctttcatggttggtctcccctcctgatcttgacgatctgcgccatgatgctgacggcgatttcttccgacgtctcggcgccgatatccagtccgacgggggcatggacgcggttgaggcaatcctggggcacgcccctggccagcaggcgttccttcacttcttttactttcttcctgctgccgatcatcccgacgtaccgggcttcgctgcgggacgcgacatagaggcactcctcgtcgaaggcgtgtccgctggtgcagatgaggacatagctgttgctgtccatgccggtcttgcgcagtgcatcggcgtactccccgacaaccagcgaatcgaccgcagagaacctgtctgcattgttgagttcgggacgcgggtcgattactgtgacatgaaaacccagcatccggccaatggccgctgcggccaggccgatatgccccgcgcccgccacaatcagtgattcagccggcatgaggggttccaaaaagacatcgacctgtccgccgcagatgcccgggcccttctcctgacccgaaaggtcgaagtgaagcaatgaatggcggcctgtgaacatcacctcgccggccttttcacgaacttcctgttccagcgttcctccacccaccgtgccggcaatagaaccatccttgtgcaccagcatcttggcgcccggtttgcgtggggacgatccgtcgctgttcactacggtcgccaggactgccttctcccctctggacagcaggtcggcgatctcttggtacatttcggtcatgtttcgaaacctcaagttgttgccgcaatgccgttctccccacgtcaagccgcattgaatgcggcgttcaccgctgcgggttcatcggcaggtttcgcaatctgatttttgcagcccgaaaaatggcgttggccactgaatcaggatctaacttcgcttgtacgcggccagttcctcggcgataagacccttgaagagttcaattttatattcgttatgctgcatgggccgcgcctgccgcattgcagcggccgccgcccgggcaatgatatcgtcatcgagggattgtcccgtgatgatcttttccgaatcggggcagcgccacggaatcggcgccgcaccgcttagaacgatccgcgcgccggccacccgcccctcgtggaaatgcagcgcaagggcgaccccggccagcgcaaaatcccaggaaccccgcgccctcacctttcgataggagctgtgaaacccctcctccgccggcggcagcaaaacggcggtgagcacctcgcccggttcgagaatcgtttccttcgtgatcccctgctcgggaagaacgaaaagcttctcgacagggatctttctcgtttccccggcgcccgcaatctcgaccgaggccccgtatgccacgagcgccggcgcgatgtccgaaggatggacgatataacaccccctgccgcccaaaatgcaatggtactggttttcgcccgccatcgcgaagcaccgggtgccccctttgcgagtgcaatgaaattccccccggtagtaccagcaccgcggtttctggcagaggtttcccccgatcgtcccctggttgcgcagttgggggctcgcgacctccagagcggcctgcgcaagggcgggatagccttccttgacaagttcatggttcgtaagctcggcgacagtcgctagggctccgatccggatggacccgtcttttaggcgctcgacgcgtttgagctcatcgagttggctgatgctgaccaccttttccgcggtgaagacaccatcgcgcaggcagccgagcaggtcggttcccccggcgtggatccgggcattgcccgccgaaagatgcgaaaaggtctccttgagcgacttgggacgcacatagctaaaattcggcatggtcatgatcacccctccttcgggacatccttaaatggttcgcctgagcttggccgcctgctcaaccgccttgaagatatgtgcatacgatccgcaacggcagagattgccgctcattcccaggcggatctcctcgatcgacgggttcggattgacccgcaacagcccctccgctgccatgatctggccgggcgtacaatagccgcactgcatggcgtcattgtcccaaaaagccttctggacggggctcagctcatcgcccttcaaaagtccctcgatcgtggtgatcgcctttccctccgcctccaggaccagggtcaggcaggcatagcgcggccggccgtcgatcagaaccgtgcaggcgccgcattcaccgcggccgcagccaagcttcgggccggtcagacccagtttttcgcggagaacatccagcaaagaccagcggggctcgaccttgaaccggtgacgccggccgttgacctgaaggctgacatggaccatctcccccttctcggccacttcggcggctgcagccggcaagggtttgcccaaatcgcccacaaccgtcgtggccagcgccccggcgcccaccagttgaatgaatccgcgccgcgaaatcccctttcgtccctgcccgttgctgactttccgatccttttccatgagtttctcccccgatgaattcccgtgatggccctcaaccgagagcgggtatcgtttcacttatgttcatccttgcttggacgttcctttttccatggccgccagcgcccggcgcagcacgagcgggctgatcggtgtcgatgtcagtctgagcccggttgcgttgtaaacggcattggccacggcggcggccgtgggaatcgttacgggttcccccagccccttggcgccggtggtgttggcctcgttgtccggggaatcgatcggaacggacacaatgtccgcggggacgtccatggccgtggggatcttgtaatcatgccagttgccggaaacgatcttgccggtctggtttcgatcgaggatccgggcctccgtcatggccaatccgattcccatggtgatgccgccgatcacnnatgttcacctcgacctcgcaaaactgggcggcaaaggggttgattgcccggttggccggattcgggccgcgataaccgataccgacgatgagcccctgtttcttcaaacccgcgacgtccgtaaccttgatctttttcgagggatcggcaagcgatagaatcgttccccctttcatcgtaagcgatgcgggtttttccttaagctcctctgcggccatcgcgaggagctgctgcttgacatggatcgcggcagcccgcacggcgggcgattcggtgggaaccgtcttgctcccgccgctcggtgttgcatactgtgtcgttgccgtatcggcgttgtcgatatcgatcagatcgggtttcaccccgagctcctcggaaacaaccagggccatgaccgttctggttcccgtgccgatgtcactggctcccatattcaggctgacactgccgtcggcaaagagcttgacaatgatcgtcgccggcggtccgccgcccccgacgacccacatgccaccggccatcccgaccccttttcgccaattccgatccttgttggacgaggcgattgcgcttctaacttcccgccatccgaaggacttggcgccgtcggtcaggcactgccggaatcccgtcgatgtatagggaggattgccggtccttgcctggctgacagcagggatgttcttcagacgcaactccaccggatccatcccgatcccctccgccagggcgtccatcatctgctccagggcccatgccccctgcggatgaccgggagcccgaaaggggcgcgacgggcaggcgttcgtatagagatcggacagctccgtccgaacattggggcactgatagagatccttgatctgccagtcgatgccgcccgttccgccggcagggtaggccccgctggtggccacgcaggtgaaatcgagcgccgtcagtgtcccgtccttttttactccggccttcaggcgcatattcgccggcggacggttccccgcggcgataaaggtctcctccctgctcaggaacagcttgaccggccgtcccgtttttttcgccaggagcgccgcaatgatggtttccttctccgcctggagtttgcttccgaatcctccgcccatgtaccggccgatgacgcgcaccttcgagaggggcatgcccaggatgtcggccgcctgcgactggacgcggtaaaccccctgagtcgactgccacagggtcagctggccgcggtcccatttcgccacgcatccgtgccgttcgagcggcgtgtggatctcgcattccgtccggtacgtctgctctaggatgacatccgcctcggcaaatccccggtccacgtcgccccgctgataacgttccggcggcttgacccggttcccgccatcatggacgaggggtgcgccgggctgcagcgccttgagctcgtccaccgttgcctgcagcacctcgaattctaccttgacggcccccagggcgtcgcccgcctgataagcagtctcggcggcgacggcggcaatggcctccccctcgtaacggcagcggaactcgaaaatcttgcccttgacgtcgttggggtaggaccatgcagggttcgcctcggggctggaacccgtcaaaacggcctgcacgccgggcatcccttcagccgcgcgcgtatcgatgcttttgacgacggcgttggggtagggggaacgcaggacggcgccgtagagcattcccggcagcgaaacgtcggacgggtaaacggccctgccgctgacaagctcatagccgtccacgcggggttgtcgtcttcctaccatgctcgtgctgccccacggcttgggggcggaacccggaccgggggtctcagggacggtttgctcatcggaataataggggtggttctcctggctcataagacacctcttgatgatgatacgaccatgccatgctcattttagagagccattcctccccgcaacgaggcgggacaatggctcccggcaaccattcggcgatatcggccaaagcgtcgtgtgacattccggatatgcttatgcattgggattattataggaggtccgcatattcttgtcaaaaagaaacttgggaacacgaaaacatgatgacggcagataaaaacggatatataatgagccatcatcgtcaaacaaccacacaaagggggactccgaaccatggaaatcatcgatctgaagattaaccgtaaaccagtccgcttgagtgtcgacgcggagcggatgctcctgtgggtcttgcgcaccgacctcggattgaccggcacaaaatacggctgcggccaggggcactgcggcgcctgcacgattctcgtgaatgagaaggccgtccggtcctgcatgatgccggttaaaatggtcgcaggaaaggaggtgctcacgatcgaagggcttgcccagaacggtgttctccatccgcttcagcaggccttcgtggaacatgacgcactgcagtgcggcttctgtacctccggtatgatcttgaccgcctacagcctgttgaaggataatccaaagcctagcgattccgacattatccggggcatggatcataacctgtgccgatgcacatcgtatgtacgcgtcatcaaagccgttcgcagcgcggcgatcagcatgaaatcagggaggaccgcatgatggaagacaaaccccggcatatggaatccgacaatgtcacgatcgattttccgatcagccgccgtgattttttaaaggttacgggtgggggactcatcatctttttcagcgccggggttcttcccgcccaggaaagagccccgcggcgtggtggacaggatctgccgaccgattttaacgcctttttgaaggttggcgcggacggacgagtaagctgctttaccggcaaggccgaattgggccagggtgtgatcacgtcgctggcgcaaatgcttgccgatgaattggatgtccctttggacagcgttgatatggtcatgggcgatacggatctatgcccgtgggacatggggactttcgggtcgcgcagtacccggtttttagggccgcctctccgggaggcggccgcggaggcccgtgccatactattggcgatggcagcggagcaattcggtctgcctgtgagccgtttaaccgtcaaggatggcgtggtgtcggacaaaaagaacggcgggaaacaggtcacctatgcccagctcacccagggaaagatcatcgaaaaacaccttgctgccaaaccgccgttgaagaaagtgtccgagttcaaggtcatggggaaatcctacaggcgcacggacagcttgcagaaagtgaccggccaggccctctacgcgggggacattcgtctgccggatatgcttcacgcgaagctgttgagacctcccgttcatggagccaagtggaagcatgtcgatacctccgccctcaggaacgatcccgaactgcttgtcgtggaacagccggacatgatcgcggttctccataagcatcccgatgttgcggcaaaggcactgtccctagtgaaggtggagttcgacatccccgagagcgatctggacaatcaaacgatacacaaacacctcctcgccgtggcgccgaaagcaggagagatggtctcggaagggggcaatctgaaggaaggggagagactggccgcgcagacttttgaaaacacatacgctgattattatgtagcccatgccgccatggaaacccacacggcaacggctgcattcgacggggaccgggtgacggtatggccgtccacacaaacgccattccccgcaaaagagtccattgcccaggccctcgggattcctgcccggaaagtgcggatcatcacgccttttgtcggaggcggattcggcggcaagagcttcaatcttcaggccgttgaggcggcccgactcgcaaaactgacgggcagacccgtacaggtgatgtggagccggaaggaggagttcttttacgataccttccggcccgcatccgttgtcaaaatacggtcgggactcgatgatacgggaaggatcgtattctggaagtacgatgtttactatgccgggtcaaggggggcggatcaaatctatgccgtaccccaccacagggaaaccgcctatgtccactatacgggaatggccggcgcccatccgttcgctaccggtccgtggcgtgcgccgggcaataatacgaacaccttcgcccgcgaatcgcagatcgatatcatggcggcgaaggttggcgaggatcccctggcgtttcgcatgaaaaaccttgaggataagaggatgctgaataccctgaaggccgctgccgcggcgtttcggtggcgaaaggcaaaagcccccagcggccgcgggtatggtgtggcctgttcgatggatgcgggggcgtgcgtcgcggcgatggccgaggtaaacgtgaaccgggccagtggtgagattgaggtcaagcgtctggtctgcgcccaggatatgggaatcataatcaaccccgacggggcaagactccagatggagggagggctcgcaatgggactgggctatgcgttaaccgaagaggttgatttcaagggcggcaaaattctgaataccaatttcgacacctatgagatcccccgtttttcctggctgccgaaaattgagaccatcctggttgagaataacgacgttccccctcagggaggcggagagccggccattacctgtgtgggcgcggtgattgccaacgctgtttttgatgctgcgggggtccggctctttcagatgccgatgacgccgatccgggttaaagaggccctgacaaaaggcaagccggagaaataggaggcttatccataaccatgtccaccataaaaggggtcaatccccagggtgacccgttacatctttatcgaagtcttcgggacagactgcttcggaaagaatgcctggttctggcaacggttatttcccgttcgggctcaggtccgcgggaacccggtgccaatatgctcatccgcgctgccccagcccctcacagagccaatcacttataccataaatgtcgaggatattgcgtcactgattacgcacagaagtcctgcattttcttcaaggcggacggtttgtggataacaggaagcagtcagtacaaagcccctccctcacaagacacggggtctatgatcaatgctaccatacatcacctcgctgggttacatggtgctttgaaggacacggagtatcaagaacttgtaaatatatccccttattccctcataatgtcaatagggttatctgaaaatattgaaaaaatcttgccatcggcattgtatgttgttatacataaccatcagacttccccacttcttgataaagctgattttataacgccaggtcctgatggagcagatccactatggttacccttggtgttgattacggtgcttcaagcgtagggcttgccttggtccgaagcgatgagaagggccataacatccctctttttgccgggacgatccgattagacgctcgctggttgaaagagaaggttgaagttcgcgccggtatccggcgattgagaagaaccaagaagaccaagagacaccggctgcgccagcttgagcaatcccttacccaaataggtctcggcgcagaacaaatccaatccattgtccgtttcagcaaccgcagaggctataaatccctctttgatgctggcgtcgccgatgatgaccatgatgaggctgaactgacctacagattcaccagggaagaatttttcaaggccctcggcaccgaactccaatcgattatcccggacacctcccaacggcaaaaggctttatccacctgcgagacgatcctcaacaggcagggcgaccgttcccttgagatccggcagatcaagatcgacaaccgcggtgcaagccgctgtgcatgggaggggtgcaaccgggtgacaccccggtccgataatgccttgggggaagtgctttctcagcagatctacaccgtctttcagtccgcgttgaaggttaatcccgtcttatgccagaaggtcgaaacggccacccatgagttgcatgaacttgccaaaaggctccgcaatgcctcgggtgaggctgcgtccaacgaaaagaagattcttagaaagagggcgcggaccattctccgggctttgaaagaattgctctacacccccgcggaaggtgtcggagacgctgagaaggcttggaaatacatcgaaacaggcatcatgaatatcatggagagccgactcgggagaaaccgctactgccgggaacacagcagggaatatgttcagacgatttgctcgggaaagctggttcccttcaagcagaccatatcggaatcggacatcatctccagacgggaacagattgcctacgcaaaactgtggcgttacattgaggcccgtattcttccgctgacccccggtggaattgaccggatcgtcgttgagaggaccgctttcgatcttcttgcgggaagcagaaagaccatccagaaggccaccgatcagttcaaggaggagatgtatcagcatggccccatgtatggttttgaaagcgtcccggacatgctgaaggaggagttcgggggtctttgcgcctactgcggccagtcgtccagcaccctcatcgatgtggaccatatcctgccccacgcggattttctcttcgacagttacctgaacatccttccggcttgcccgaagtgcaattcagacttgaagggggatcggtccgtttcggatgcgtcattgaccatccacccggacgcatacagggcctacagcgattatctgaaaaagaagttcagcacccgccccatgcactacttccattccatcaagaagggtgtcctgaacctgatgcaggatgcaagccgcctctgggaagcggagcgatacctctccctgattgcgcggcagtttggccagatcgtccaatcccagcggggtccacgacccttcgcccgttacctttccacaaaactttcccgcaggcaggggcaggccccggcaatcaggttccgcaatggccgtcacacggccctttaccgccgcgtggcctacccagattttcagaagcaggcggaaaaggcagaggggaatgtcctcaaccacgccctcgatgccatccttctggcttcggaactcccggatctataccccgtggaggctctaaacctgcctttgtggcagttaaagaattgggctgatacagtccgggcgagagccccgaaatccggggatgagggcgttccgatctgtccggacggccctcaatatgtcgacggctttgagacggttcaccccggcgggtatgtggaggtggatctgcggtccatgcgctggaaccagaaggacagcatgacccacaagcaggacccctacggcttttctgaaaaaacagggatgcccaccaagagaggttccgccttcgatctttacacaaaactgaagaaggaaaagaatccatcgaaggtgaaaagccggatcgccctgatccatcacccggcgttgaggaaagccttgtcggagagcctgcaatccgataccacgggttcatcggcggcggagaacttgaagacatggctgcgcatctccgtaaaaaacagcttggcccattcccgcttttccaatcatcccggtgatcaggccagaaggtcagaactggagaaatttatcacgcaggaggattgtccgatcccttcggtcatcggggtcaagatgttcgacatgggtgtccgcggcaagattgacatgaaaagactggacaggcagacgggcggcattggacatcgctatatgacccagcctccgaacaagggggtcattgtagcctatccaaaacgggaagacgggaaaccggatctgaccaagccttgctgcgtctatcacaagcaggatctgtctatgacacctgaaaatatcagcatcttcaaaccgccgcctccgatcctgtccgatggggtgatccttgggaaaaagccgtatgacaaaggagatagacgcaaggcgcttgaaaaatatctctcggactgcggttttcacagctatgtatacttgacaccgggatgtaccatccgctacaaggatggaaatgaatggttcgtaaggaattttgactccagcgaggatttcaaaaagggcagactcagggaaatcatcggcacaaggagaactcctttcgttgacagtctgattccattgaaagtcctgtcccaatagggattgaaggtaaagcatcaaccgttctttgacaattcagaaaaaaatatcagttccggttgaaaagagcatccgtccggagggtgcactccgggatggggcagtcccggcacttgcgttttccccggcttacgcttcggaaaaaggcccttcggcacgtcgaaagacaggatgtgagcccaatttaaatattgttacggtttgtttgattcaccaaactgatttcagatggtcattgtgactcggttgtcacgctttcccttccctgatccattgaattgtttcaatcaaactgatttcagatggtcattgtgaccggggcagacgttcttcctgctcaagatgtcgtggtttcaatcaaactgatttcagatggtcattgtgaccgtaccccttgaaacgattattgcgatgctgtcgggtttcaatcaaactgatttcagatggtcattgtgacctgccatctcattcccccaccatccttttcagttgtttcaatcaaactgatttcagatggtcattgtgaccgtctgactgaattgtcaaagaataacgatgccttttacgggcctttccgcgaacctccggagatcggcggattttttggcgttctcagggcaggcgtgcattgctgtatacgaccaactacccatatccatgagttattccactttccgcgaacctcaggccattatctcaggaacgtgtgaggaaaagaggccgccaatcgaaattgacgacttgtatttgaaaggctgtatgcctgtcaagattacctgatgctacattacaaggaagtacatatcaaccggatgaaccagaatatttatgttaaaaaaggctccaatgctgtacgatattacccggcaacacagaggaggttatatgaagaaatccgatcagggtaaaatcggcccgaaaaaaagcagcgaccggttatgaatcatatcagaaatttcagcattatcgcccatatcgaccacgggaagtcgacgctcgccgaccggttcatccagtacgccggcgtggttgaggaccgcgattttcaggaccagatcctcgacaacatggatatcgagcgggagcgggggatcacgatcaagagccaggtcgtctcgctcccctaccgcgcgaaggacggccggagctataccctgaacctgatcgacacgcccggccacgtcgatttcacctacgaggtgtcgcggtcgctcgcctcctgcgaaggggtgctgctgttgatcgacgccgcccagggcgtccaggcgcagacgctcgccaatctatacctcgcgatggagcacgatctcgcgatcattcccgtcatcaacaagatcgaccttccgggcgcggacgttgaggccaccaaacagcaaatcgaacacgctctggcgctcgatccgagcgagtcnngggatcgaagagatcctggaggccattgtggcgcggatcccgcctcccaaaggcgatccggcggcgtcgctcgccgcgctcatattcgacgccaagtacgattccttccggggaacggtgatccactgccggatcttcgacggcgccgtgaaggcaggcgacatcatccggttcatgtttaacggcgcgacctaccgggtggaagaggtcggccacttcctgctccagcgtcagaagcgggagagtctctccgcgggggatgtcgggtacatcatcgccggcgtgaagaccgtctccgacgttcgcacgggagatacgatcaccctggagaaccgcccctgcccgaagcccctgcccggcttcaaggaggtcaagcccgtcgtcttcgcctcgatctaccccatcgccgcggacgattacacggacctggccgactctctggataaattcaagctcaacgacgcctccttcgtctatgaaaaggactcttccaccgccttgggccagggcttccgctgcggctttctggggcttctccacctcgacatcgtccaggagcgcctggagcgggagtacgacctctcgatcatcctctccgtcccgagcgtccgctaccggttcacgctgaaggatgggacggtcgttttcgtggacaacccggcccactatcccgaaccgatgtccatcatcaaatccgaggaaccctacatccgggcggcgatgatgctccccgagcggtatctcggcgccgtgatgaaactctgcatggagaagcggggcgtgaactcgaccctgaactacccgagccccggccgggcggagctgatctacgagatgccgctcgccgaggtgatcttcgatttctacgaccgcttcaagtcggtgacgcagggctacggctccttcgactacgacctgatcgattaccgggagagcagcctcgtcctgctggacatcctggtgaacggcgaaaaggtcgacgccctctcccagatcgtccaccgggagcgcgcccgcggccggggtctccaggcctgcgaaaggctgaaggaggagatcccccggcagatgttcaagattgcaatccagggggtgatcggcggggagatcatctcccgaacgacgatttcccccttccggaaggacgtcatcgcgaagtgctacggaggcgacatcagccggaagcggaagctcctcgaaaagcagaaaaagggcaagaaacggatgaagatgatcggcaacgtcagcatcccccagagcgccttccttgccgtcctgaagtcggacacggaatgaacggatggacaaacgatcgatcccgaatccggccggaaaccctcttcatgcggttcaggaatcggatgaactcccgggtctttacatccacatccccttctgcgtccggaaatgcgcctactgcggtttctactccgtcaccgaccgttcgcagatccccgactatctggaggccctccgccgggaaatggatttctaccgggggtgggccgcattttttgacacactctacatcggcggcgggaccccctccgttctgcccgccgcggaacttgaaaaactgatcaccgacacccgcgggacctttgcgatcttaagcgatgcggaaatcaccgtcgaggcaaatcccgcagacatcgacgcagggctcctcacggcgctccgccgcaccggagtgaaccgcatcaacatcggtattcaatccttcgatgacgggatacttgcctttctcggccggcgtcacgaccgggagcaggccgttgcggccgtcacggccgcccggatcgccggaattgaaaatatcggcatcgatctgatctacggcatccccggccaaggcatggacgcctggctcgcgacgctccgcgaggccgtcgccctaaatcccggccacctctcctgctatcagctcaccctggaagacggaacgcccctcgcggagcaatttcgaaggggaaaggtcgtccttcccgacgactcccttcaggccgattttttctgcaatacatcggaatttctggaagataacgcttatattcactatgaggtctccaatttcgcccgacccggcagagaatcgaggcacaaccgaaaatattggaaccatgccccctacctcggcctcggccccgccgcccactccttctcgggacgcgaacgccgctggaaccgccgcgccgtcaacgcctatatcgacgatctggcgtccggacgaacgcccgtcgagtccagggaaatcctgagcgacaaacagctccgcctagaggccctctttctcggcttccggacgcgccggggaatctgcctggagacgttcggaatccgctacggccaggaccttctcacggaaaaacgggatatgctgaagaggctttccgaggaagggctcgtggagatccgcgacggatttctccggccgacgcgcgcggggatggccgtcgccgacagccttgccctgatctgaaaagaggcttcacaagaattccagagaagatcgcgcgagctggcgctggcggcaagccagcagccgcgaagaaacgcccgctacggcgcggtcttttcgggcttctcggcagcctctccgttgtcgcgaccccattctgtgacgtagacgcccagcagaatcatcacgccataaagcatcacttggagcgtcaatttttccgccagccaccatgcacccagggcggccgtgaccagcggctgaaggtaactgaaggccgccactcgcgaggccataagttcggtcaacgcaaaagcataaagcagatacgggatgaccgaaccgaaaaccaccatgtaaagtaagcccaaccaagcagaaattgaaaggcctacccaattggcctcccagacggactgtgccccaaagggaatgaggatgattgcccccaaggcaaaagccagcgtgttcaaggtgagtgcatcatagcgatcggctaactctttgaccaggacagtataagccgcaaaggtagcgctgccgccaaggagaagaacatctccgagccagtagttcccccattgctgactcgcttggccaatcgttaacaataccaccccactgaaagaaagcgacatacccgcaattttctgaaaagtaagagcctctaagcgggccaagcaggaaatcagcagcaccataaccggaccggtggaagaaatcagcccactgtggacgaccgaactcttggacaggcccacaatgaaaaagacttggttgagacaacttcccatcaaagccacgaccacgaagaatagccaatcccgccgcgtcagttttaaccgtgggcggttgcgccaaataagaaaaacggtcatgtaaacgatagctgatagcagcactcgcagttgggctaaggccatgggcccaaagccctgcaaagcctctttaccggcgactggagtgccgccccagcaaagcgtggcgagaaccagtaacccatacatgcgggcgggggaggtacttttccggcttgtgggcgagactgcctgctcgctgatcgcggggctactcaaaaagctcctttcgtaccgtgagcttttcgattcgttcgagattgggaaggtagaccggtccagggtaccgtggaacccggatcgtcccttgagagctcactgtcacttcgggatcaataatgtcctccagccagtaccggcggctggcggagacatctccgggaaaacaaaacccgggcagcgtggagagcgcaatattgcgtgcgcgcccaatgcctgattcgagcagccccctgcaccacacggggattgtgtggacgcgacaaacatcataaacgcggcaagctgccgtgaacccaccgacccggccgagcttgatattgataatcttgcaggcaccgatctcgatcgccttgcgcgcgtcgtataagatattgctttcgatgtatcgaaatatagggaggctgtttttgcttgtcaagggatattatgcatcgtaaagcaccaccggatttttcccccgatcgccgtcgactattggaaactgatcttcgaatggatccggaacccggattaccgtaggatgtttgccattccgttgacggcaccgccgatgtctggtccggatctgtccaaggttcgcattctcgcgacatggcgtgtatatgagaacgcctgcaacgggtgcgtccaatgctgcatccgaaggtcctgcccgttgctggacgccgaacgaaacagtgcagaagctacggttcgtttttctgccgctatttcatctgcgggcgatatccggaaaacgaagcgaaaatccactactatgatttgcccaagtgggaagtttgcgagggatcccgatatttcctttcgtagaggcccggatcgtatggggccttccgatcagggcagtcttcgcgagggcagagctgacaactggcaaatccttcctcgtttgcgaaaacaatgcccgagagggatttgacgggcaccatgagcagactctccgtcagctctacgccgatggtttttcgggtgtctcccagaagttcaaaaaggacccgttgctcctccaggggccagtcaggcaacgagcccggactcatgcgcgccgttttcgccaggccgaagcgttcctgcagatgccgatccaggaacgagcgggcggagatgaccacggcctgattgattgcatccgcccagaaacgttccaggagatcggtcttggcgttcgcccaggcatccaattcgcggcccgaggtgaccacaaaggcaaaaaaatggtgaaggttgtcgagattcaccttcaggacgcggctctcgaaccggagttccccggccaccacatgccgatcgccccgcgactcgatgaaggccatccggtagatcgcccggggatgggcgaccgcctccgcctcccggatcaacccttcgacctttgtcgcatgtccgctgccttccttcaggcgcaacctggccagcagggacggccgatcgattcgatattccagaagatccaaaacaacgcgttccatcattcttctgccttcccgctcaggagatcacaggattcatgactgtgatg

SEQ ID NO: 102 - DNA, 5280 bp, synthetic construct
  misc_feature 1..5280: note = Synthetic
  source 1..5280: mol_type = other DNA
gtaacccgttcctgtttcttgcaaaatagaaactcctttgagttcctggtcgattccataactgctcatcgactcgcattacccactccctctctcgtcaccccccccggtgaacggttaccatttctaagcaaattgactaaaattgctgcaagtagagtaccaggtgtaaagttttgccggaccatcaccctgcttagataaaccctttttacctcaattacagacccaccgtatttctctcatgtctctgtcgtatgatgttcgcatcccggcgggtcagaattaaatttgagcaaacatgagtgcctttgcgggctccccaacgaaagcaaaatgcgcaagtgtgcacccgaacgggattgtctgcaacggattgcagtgccgcggtttaacataaaactattactgaaaatatggagcggctccgccgaaccacaaaaagacccgatggctttatgaatttggactgactctcatcgcttcggaatcattgcgacgccattgatgtcttcttggagcgagtgtatatttgtactcgtgttttcaaggagttgatgcatgaccaaatcggaacttatggtagcgctgtctcaggaaatgaatttccccgtacgaaaagcagaagaaattgtaaacgtagtatttgacacaatgacaaagaccctcgaagacggaaatcgcattgagattagggggtttggttcctttatggtcaaggaataccagggctacacggggagaaatccgaaaacgggtcagctaatatcggttactgacaagaagttaccttttttcaagcccgggaaggagcttaaagaaaaagtttcaaaataaggttccctcttacttgcctaattgcagccgagcgaaatgcaaccctcgttcctaagaactgatgaacaaaaagatgctctttgttcattgcagctggtttcagagcagttgcccaaggtccttgataatcctctgaactggaagtgggtaataatagccctccacaatgctttgcaaggattcatggtattggctttgaaaggttctgatagccttaatgtactgtcgaaagatagctgcgttgagtggctcgccgcctatgacaatcccgacagttctctgccacgccttaaaatagatgatttcatgcgactatataagaaaataaaaatgggtaggggtacctacgataaggaaatcctgaaggaatccgctgttccgagaaaacaatcggaccttatgcttatgtattccggtagcgtacccttcaaacccatcggaacccagtctgacagcgttaagctgctccaccatctgagaaacgattttatgcattttctccccaaaggctggtccatagacctctccggtcttcccaaaatggtgaacgactgcgttgatatcatagaattccttgccttcgaatgccacaatgttgtgtggaacagtgccgaccttcaaaccgagatacggcaacttctagataagatacgactcgccggagaagccttgagggctgttcgtgagacatgactatactctcagactacgaactcatggcgatgttgttcacaataatgaaatgtcaataagtgcctccctgttgaacatgacttcaagtgtggggaaatcaaagccctcttgtgcagcaaatctattcagagagagtagaccgagcgctcgagcaccaatttgcaactccgctcaataggagcaccgccatggacgctgaaggtttttgctttgcaggtttctgggcagaccaagaaaaacgtcgtgccgagaagaaagccaaggaagagagagaaaagttgaaagctgagtacgaccagtggtgcaaggagcatggcataccgcctccgcctgataacgagttatgatatctatacttaagatagtcgggcaccgaacgatgttggaccaatatagggaaaagaatttctgttcaaccgacttccgtttgggctacaatctcaagtagctctccaattcttctaccactgacaggcaatcgccatgataactctcgcaatagactatggtgcggcaaacataggaatagccctggttcgtaacaccaaggacggcaataatgaacctctgtttgcaggaacagtagttattgatgccaaccgcatcaaagacaaggtcgaacctcgtgctggcatcagaggactgagacgaacgagaaagacgaagagaagaaggctgcgaatgctgggagaggggctccgtgggcttggcttgggcaaggaagagattgctcgaatcgttggctttgccagcaggcgtgggtataaatcgctctttgacgacccggatgaaataaaagaaggtgatggctctggctatcggtgcacgagagaggaattcttccaccagctggagcttgaattacgggaaatcattaaggagcctgagctctgcaaaaaagccctcgcggtctgtgaaagaattctcaaccgcaaaggagaacgctacggcgaaataagacccctgagaattgacaaccgcggcagaagtcgctgtgcgtgggagggctgcaacaaggtgacgccaagacgggagaatgctaccggcgatgcagtggtgcagcaactcgtaacctattttcaaagtccccttcgtagggagcccgacaagctctccatgcttgagcaggcgattgccgaattggacctcatatccaagaatctccggggttccaacgaatccaaatccagcaatgctcttcgcaaacgagcgagaacgattctacgcggtctgcatgctgagttgccaatgcacgatgaggaagaaggcagcgataaagagagctggaagtatgtggaaaaggggatagtcaatatccttgaaaacaagggcggaaggaaccgctattgcagagagcatagtagagcacacgtgcaaagagtactggagggcaaaccatctgaattcaaaagctccatccaggagtctgacatcatttccaggcgcgagcaaataaccttcagtaaactatggagatatatcgaggcgaggctcctcccgctggctcccagaggcatcgacaggattgtcgtggagcgtaccgcattcgacctgctggcggggaaacagaagaagattcgggatgcttccagcaaatcggttgagagtatctatcagtatggtcctatgtatggtttcgccagtgaaaaggaaatgctgcgcaaggagttcggcgggcgctgcgcatactgcgggaacccttctgagaatctattggaccgggagcatatcctgccaaggaaggatttctttttcgatagctacctcaatattctcccctcctgtccacaatgtaatgccgccaaaggagcctctcttcctggagtgagctctctcagaattcacgaggacgcataccgtaactatgagagctacatcaatggcttgaagagcaagggacctctccatttcctccacaccgaaaagaagggcattctgaatctcatgcgagaccctgacagggcatgggaactggaacgataccttggtctcattgccaataatttcgcatccattgttcagacccagcggggtccacgcccttttgcacggtacttgtattcaaagctctcccagaggcagaagaagcctccggagattgctttcagaagtggtcgtcacactgcattgtataggagcgccgcctatccactgttcagcaaagctcaggagaaggcggaccaagatgggaacgggcatcctgtgaatcatgcactcgatgcgctcttactggcatgtaaactgcctaagcctgagccactggaagcgcggggaatcaatctcggcaatatcagtgcatgggggaggcaagttcgagccaaagctccatcagcaggcgagaatggcattccagtcatgcctgcataccagtggcgcgtgccggggtttgaagccacagatgcacacgggtatataacggttgagatggcaatgatgaactggaatcaaaaggacggggcaaccacaaaacaggacccgtatggttggtctgaatcaagacaaaagccaacaaagagagtctctgccaaaagcctctttgatgagctgaacgatgaaaagagtaagaagaatcccgctgagctaatcagccgtatctatcatccagctctgcgctcagcagttcaggatgcgttcacggcttctcataaccgtgctgacgcagccgatgctctcaagaagtggctgagagattcggtgaaaaacagtcttgggagttcaagcttttcgcgccatcccagcgacagtcggcggaaactggaccttgagaaattcgccaacgacgagacagaagaaattcctatggtgataggggtgaaatgcctcgataccggtgttgacggaaagatagatgctgctcgcgtagaccctcaaacggggaagacggggcaccgttacatgactgaccctgccaataagggagtattgctcgcctatccagcaacacggtcaggagcgtgtgacagaagaaaaccatgcatagcgggtatcaggcagaattattcactcaaaactgacggtacggcttttggaccactcccaagggtattggagcgaggcgtggtctggggcgaacaaacgtactctctcaaactgatggagaccgccttcggtaaagaattggaacagtatctctctcaatgcggttttcacagctactgtattctcactgctggctgtgtggtggtctacgaggacggcaccgagagattcatcaggaacttcgacaagagcaaagacttcaaaaaggcaatcctgagaaacattgtcggtctgaagcggactccgttctccaagcaagttgcgccactaaaagtgttgacacgagaccctgacagggactaagaattaaaaaacactcgctctttgacaaatcgttcgatattttcagctccggttgaaaagagcatccgtctgatagccatgcactccggaatggggcagttccggctcttgcgactcaatgggtgtatgctcattgagccaactgtcagacacgtctctctgagacaggatgtgagcccttatttacaaaaacaaaagctgattcttccgtagtcgttgcgactaaacacggatgccgaaaggcatcattcgccaagtttcaatcaagctgattcttccgtagtcgttgcgactccgggaacgatttgtcaaagaataccctaaagttatcccatgtgttttgcgaacctccctgctcttgaccaaatcgaggctccctgattctcgttgtgcgtttaagagctatcg

SEQ ID NO: 103 - DNA, 4841 bp, synthetic construct
  misc_feature 1..4841: note = Synthetic
  source 1..4841: mol_type = other DNA
atgctgctattcttttagagaaaaaaggaagtatttggtctagaacgatttcttattgaagaagcaggaaattgtgatttggtgggagcccaagtagacaagagtcgatgcactctgaacaagccatcatatggtgggtctgggcacagatgaaacagacatagatcgtcatgaggggctcctcgtacacttggccgagttttcttcagtggttacgtggtttaaacagatacgcacctcgttggcgagttgtgttttgagcccggaggaattacctgatgtgcatcattatccgcaataagttgtttttgagaggacctctacccaatcatttggacgagaaacgaaggaggcattgttgtgaatgactcaagtcacaactcgaacaaaccagatgtacttaatctaacactgtggacgcgtagggctttatgcatcccactgctggcgcttgcggcgattcatctaatctggccggagttagcaattgatgcagtgttccttggcctgctagccttagccgcccttctctggttcttcgacgtcgagagcatcgaatggcagggcatacgggcgaagcggcgtgagatcgcccgtgccaaagaagccatagatagccttcctccccctcctgacaaggccttgccgttgaccgtaccgacactacgatttgaaggaccatcgcccgcggagatacgggccggcatgcctcatccaattccgattgaagctgagcttccatatagtctaattgagcgactattcctgaccactgagcagattcgaattgagctcatagtccttgcaggaaacggcggatatcttcctctggttaggccttgggatcgatattcgatactggagctgagcagtattctaagaaccaggaatctcttgccccccgcactcgttgaggcgattgctacggttgtaaaagcccccaacggaattgcgcatgtaggggtgatcgatcacgcctcagaccttgctttagatgtcttagcgaagctacgaaggatccctcgaaactacatccgaattcgcattgaggatgtagaaatctttcgtgattgctcgcttttaacagtacacgctacccggggtgtaatggtgacgcatatagaccaaagcggtattatgcatccgccacaagtatttccgagggaacaggtctttctcaccggtcgcttttgcacgtgggaatggaacatggcgcgcgtattccttgaagaaggctggtaccgagatttaatctcgggtgagccgaaggaagcatggtcttcatccgcaacttttggcggtcgtgagtacccggagcaatgggggctggaaaatcgtctacctaggcccgagctcgggctggagtaacgtctaattaagaaaaggggactgtatccttttccgtcatggaatcaggaaaagaaggacgatgaaattctttatacgattgctcatgaattagctcatcttttctttgaacatgatggagggggtagggcttgtgaacaagaaaaagaagccgacagaaaagcaataaaatgggggtttgaaaaggaactgagagctacacctcacaattatctttttggaacagggcttttgctgaaaacctttggtgaggttacccttgtaaagcacaattggaaggggaaaaatatgataaatgaagcaacatgcatgaatgttatagagtggtacaacacaattgaaaaccaactaatagattttttcaaatatgtccctccccaaagtcagaatatgagcacatggtctccccggctttccactttgatcgtcgagagttgtgggctgattgattctttgctacgatatatttcacctccgaaagtccaactgcgcggaaaagtgaagagacgagaaaaattggagctatccgactttgcagaactgtattctattgaacgtaagctacctaatcgcaaagtaattctcctaatatcgcctcctgagtaccgtaccccatttgatgtttggttaaaccaggggaaaggaatttctttcgagtccccatcatggtggacaacaaataatcatcttaagcaccgcagaattgattgtttcacggaagccactttagaaacagcaatcaatgccattgctggttcactcgtaataattgcaacgacaccccaactgattcctgtactggcacggaaaggatatttggatttaagtgatcgacatgcctccagtactataaaaaatttacaaaattattatggcgaagtgataactttagaaacatctctgtttgcaatgagttttagcagtgaccctttgccagataacattcacgagttcaatcctcttctctctggaggaagtgccaggttaaaagcgttttttgttagaccttaaaatctggggggttttatcttcaacttgccctctgtattgatatttgggtacgttggtgcaaagagaaataaaaagaaacataagactttaaatgaggcggggtaaactagggccgtgccaaggcaggcgggatggtacagaagttgggatgcacgggggtgccagtggcgcggtttccggaggtgacagagttaaatggatgggacaaggggtttgcatttacccctacgtccccctcatgtctctgccttttatgaagtgccggacacgaatgacggtcacggacacgttttaatatcttggcacaaacctaaccgtggtatattatgtgcaccaggtgaagcgaaaaagagaatatcagaacgtttaggatagaggggctttggagaggatgaaacaattcaacttaatcaacaacgatccactgataaccaatttaaaagtgaaggtggacaagctccaaattctcattgacagcctgttccaaaaggcatacaatccaatcgaaattagagctattcgcaattaacctcaaacctattgggtgggatatggtgtaggaatgatttagaaccccatttctgaaaagggaatggggttttattgtattacatccgtaattccttaaaggatatggagacaaaggtaacgctatccattgatttcggttacaagaacatcggccttgccttggtaagaaaccaggagggaataaatactcccttgttcgctgggactctcctatacgatccctttcaactcagcacaaaggttggaccgagggcagaactccgaagagggcgccggaccagaaagacaaagagacatcgactaagctctttgaagaggaaattgcttcttttaaatctgccagatgaaacagtcaaacagtttgtcagcttctgccaccggaggggatatagttctctatttgaaagggaagagatttctgagaacaaaaaaaccaaaccagaagaagaaatcgttttccgttttagtcgggaagaatttttttctgccttagaaaaagagatagagaagctgttacctgaagaaaaaaggaaaacagttcttaccatatgcgaggatattcttaaccgtgccggagacccgtctaaagaagttcgcccactgagaattgacaatcggggggtctcccggtgtgcctgggacggatgtgagaatgtcacaccccgcagggataatgcccttcgggaccccatgtcccaattcgttcatacggtatttgccgcaagtctcagaggcgatacaaccctccaggatgaagttgcaagaatgttggaccgtatcgcggttttgggaaaacgcctccgtcatcgcaaaggccccgatccagataaagagcgcaaggctctcaagggaaagattagcgaagaacttaaattgttaaaaaagctgtatggcctaaaccctgatttgactgaagagacggctactccttgggcgaaaattcggcagaatataacgaatctgatagaacagactggagggcgaaatcggttctgccgttaccacagttctcaatatatgacccacttcatggaaggaaaaccgatacccttcaaggcaactttgaccgaaagagatttggtgtctcgccgggaagaaatccttttccaaaagatgtggcgttatatcgaggcgagaattcttcctcttgtccccgatggcattgaccgtgtgattgtagagcgaaccgccatcgaccttctggggggaagccgaaaacagcgtcaaggcattatgaacaaagaagcccttgaggagatgtatcagcatgggcctcgatacggattcgggaatgaccttgaaatgctgaaggctgaattcgatggtctgtgtgtgtattgtggcaggccaaattctgaattggttgaaagagaccatcttttgcctcagtccaaatttttcttcgacagctacctaaatatagttcctgcctgcccgccttgcaatcggaccttaaaacaagctgcctctccaggaggggcttcactcaggattcacgaacaggcatacgatgcctattccaaatatgtgacttccaagtttacgaataaacctccccatttgtttcataccatcaagaagggcgtcctcaacctcatgcgtgagcctggcagggtctgggaagcggagcgttatctcaacctcatcgccaatcagtttgcccaggtggttgggacccagcgaggacctcgccctcttgcccgttaccttagctggaagatttcccaaaagttcggggagaagccaaagattggatttgttaatggcagacacactgctctctggcggaaggctgcttaccctgaattcgataagtttagggagaaaaaagagggtggtgttatcaaccacgccttggatgcactcctgatggcttgcgacttgccggacctgacttctcttgaagcgaggaacttgcagcctggtttgat

SEQ ID NO: 104 - DNA, 13103 bp, synthetic construct
  misc_feature 1..13103: note = Synthetic
  source 1..13103: mol_type = other DNA
accacgcggaccgcctcggcgtgcccagtgtcgctatgacagacgctatcgtagtcgggatcgggcacatggccgcccgtgtaaccgacctcggtttccgtgacgccgtcgacgcgtcgaaacgcggcttcaacgccccagaagcaaccggctgcgaacgtggccgtcttcatgctcttctccttgttttccctagtggatccgtctttggacgaggtttgggcttccgtcgatcttgtaagcccctcgtcgctcgagttcccggcgagggtcacgggcgccgacccggccgcgatgcgctcccgctgcccgacgtcgggcagcgtgccgtcggccgagacagccgctcgatagccgagcaacacggtggtcaccccggcgacgacgaccgccccggccacaatcagagccgctggttgaatacttctcattgcgttctccacggaaggcaagaggcttgctccggagttccaagttcggcccgtgcgatgccgaccgccaggcgacgctgcatccgagccgcgatcctcggcgagcaggacagctcgacgggacgcatcgcccagccgaatcgagcgttcataagccggccggcgactggctcattctcgccgcgaaaccaggacattctcgtgattcccgcacacgcggtaacattctcgtcattcccacacaggcggcagcattcgcgtcattcccgcgcacgcgggaatccagtgggttgcgtcaatagcttggacccccgcgcacgcgggaacgacgtccttcagacggctgaagtgatacggctattgctattctacccgaccgaccggggcagggtaggtcggctggccgcgagcgaacgaggtattgaatatctggggtgaatgccgaccggacacatcgacccagtgcagtgccgcccatgggccgttcagcggttttccccgtcggcgtcgggcacgatctcgatccaacgagcgtccagttcaacgcccgggccaccgcgggtgcggtgaccttgcacggccaggacatttttgccaatgtgcagcagcttcagttcctcccgatcgagggggtgctcgaccacggccggacagtgccccgtggaatggatcagttgcgtaccgttgagaaagatacgcacgtcctcgtcgtggcgatagcggaggacgaaaccaaccggtgtcgcttctagctggaagtcggttcgcagccagatcggcggcgacggcagcgcgaccggcccctgttgcctcggtggatggaactgctcgaccggccaatcggaatcgtcgaagtcgatcgtggtccattcgggcgaaggtggttcggtggcgtagcgccatgggtgtcccgacgaggcggtgccgcggatgccctccaccacgcgtgcccgatccagcagccggttcaccgtcaccggacggaacgacgtcaagccctttctcggtctcagtggtcgcgacgtttggatgatgagcgttggatcgatcacgtagcggcccaaacgatggccatagatcgacaatcccgccccgtcgctgccggagcggaagaccagggggatgtagggtttctcgtaaatcgcttcgcgcacctggggatgctctcgcagatcgatcagcttccggcttaggtagccgtagcttccatgatggaatcgtcgatggtgcgagagcacgccgcgtgagtcggccggatcgtccggcaacgggaattcgcagagcgcatttcccagcgaagacacttccacgcgacccgggaaagtccgagcgggtcccgatcggttggtgcctgcctgccaggccggcgatcctcccgccgtggctgcgccgaacgtcgtggctgaattgattgggctcgcatccgcccgtgtggccatctcggccatcagcaccaccttcgtcggcagggcatcgcgaatgaactcgggcagtgccaaatgatactccacttcgcaattgccgtaggcgtggaacttcccctcggtggtcaaccagtcccagccgaggcgatcggtgcggaacttggcgaactcgcgtggcgcgaaccgcacaacgaccaactcccggcccaacacttccacgcggggcgagtcggcgaaccgatccagtaaccccgtggtcacatctgccgaggcgtcggccacttgtccaatcgcgcttgaaatctgcccggcggccgtgccccgatcaacaagcgtcgaacccccgtctgactccgccgcaccagagtgatcaatcagaagattcacgtagttgaccgccacgcgacggtcgctggcatcgagcaactccaactcgatcgcgccgatcatgcccgttgtcccgggcatgcgtacccgaagcggttgctgaaagctcaccgtgccgtgctcccaaacggcggggcgcgagccgctgccaccgtccaccggtcgtcccagctgatcggtcccggtgatccgccaggccagtcggggtggtcctggagcggtcgagtagtgagccgcgaacaccgacagcgccacttgctcgccaggggcaacttgcagcatcggcggggcgtccacgccgacgaagtcctcgccaagcaaatcgctggggcccatcccctcggcaaacgcctcgtagccgaacaccttgggcgagcgatcggcgtggagcaaaccgtcgtgccgccactccacgtcgtacaacgaggcataatacatgccctggagcaggtcgtgtcggcgcagttgcgttaccaaataacgaaaggaccacgacacatcggcatggacgccacctggtgcaatcgccccgaattggctgcaaaccagcggcgcggtgccctgacgtcgcccgggcacgaaaagggccggcgaaccgggacgcgtccgtgagatcacccggttgatgtgttcgcgcgcaatccaatagtcgtcgatccggaattgccaggaattgacgtcggtctccacgtgatcgccttcgccggaggccatgtcttcgatcagtcgcgaggggtcgagccggccgcgaaccacctcaaccatctccgccacccagtcctgcaactgctgatcgcgacgataccacttttcgcccagcccccaaccgttgtggaacagggtccagccgacgatcgacggatggttcacgtcgcgggcaatcaccgcgcgcatcgttcgttcccacgtcccacgtgccttggggctgctctcgtgcgtcgagggcatttcgggccagatcatcaaacccagccgatcggcccagtagagcttccgcggatcgagggctttgactcgcgttcgcagaatgttcaaccccaaccgtttggccgcttcaatgtcggctcgtaagcgaccgtcgctgggtgccgtgtaaagaccgccggggtagaagcccggatcgaccgcgccacgaaggaagacgggcgtgccgttgagcaggagcatctcatacgcggaatcgcccttcgcgccgcgccggagttgtcgcaaaccgaaatagctccgcaccacgtcgcggccgccatcggcgtcggtcaccacgacctcgatcggatataggtgcggatcctccggcgtccaacagcgcggacgatcgacgccgatcatcgtccggcaggtgcccgcaccatcttcgatccgcgccgagcgttgcacctcgcggacgtggggcgacggggaatcgatccgcacgtcgaccgccccatccgctccagccaagcctacttcggcctcgacgacccattcgccggataccagcaccggcgtgagcttcagttgctcgacgtggcgttccgggcgtgcttccaagtaaaccgtttgccaaatcccgctgctcggcgtgaaccagggtggtccctgaagccccaccggcacgtcgggcgcggtggcgtcgaaagcccgcacgtcgatcacggcctcctcccccggggcaacgtgctcggtgacgtcgaaggcaaacggcgtgtagcccccctcgtgacgcccagccgcgcggccgttgacccacacgcgagcttcatgatcgacggcgccaaagcagagccatacgtggcggccgcgccagtcggcgggaatcttcaccgagcggcgataccaaccgatcttccttccgcttcggtcggccacacccgacagctcgctctgccaggggaacgggaccacgatcgatgtcggcaattcgcgccggattgccacggcgttgtccgcccgcgcgccacttgccttcgcgtcctccggcgccccccctgccgccgacggccaacgcgccagtcggggccactgctcgcggagccctcgattctcgtcgtcgaagcggaactgccaccggccgttgagattcaaccactcgggacgttcaagttgaggacgcgggtgctccggccgcgggacagactccgactcccacgccgcgccccggccgacatgcgcgacaaagcagcacgcagcgaggagtggaatcgcgcgcttgagcgggaattgcatggggggatcaattgcgtgtcgtgccggccgagaacaacgtcgcacgaagaagattatcgactgcccaagggccgtctccccaatgccatgcccccggcggcgtgaggcacgaccaaccccggtggctaaggccgggtaatcggcgtaatcgataatcctaggagcggcggtgcccattctccgaatccagccaccggcggcgttcccccatggaacgcacgcgacaggccaggcagggcatgtagaccaggccgccacaacccgggcagcgttccagcgggccggtcacgtcgaaggcctcggtttccgatggtcggcacgaacagggtgtggcgcgacgccgaccggcggccaccgcgccaaccgtcccgcggctgactcccaccaggcgagcgatcttacgctgcgaaacccggccttcctccaacagttcctggatgcgttcaatcttttccgttgcaatcatggctggttgccctcgtcgtttcgagccccgatgtgcagaagtgaatgtgtacgcatgttcatatcactaaccgggcatcattgcaatccacgaactggccaccacgcccgttttttgatgcggatcggcctccgcgtggccggaatcgcccgccaagccccactttagacccggtccagtggatcgcgggtggagcgcgggatgagccgggggctggcgtcgcggaacgccgctggaggagatgaccactcgccgccggtggaaagggctgacgtttgaggagacctggccggtcgcaggcgttggggcggtcgtggatttgtcgttcaggtcgaccgcgcctcggcgacgatatcactcaccacccccccccaacgaacgcaaaccctggtgtggatcaagatgtctccggccttattgaacgcggtacttgtcgtcggctttcttgccgtttacgtgatggccggagaggcactcgttagcgtcagacgccatcgccggcgtcggctgcactcggcccacgggctgaacgatccccattggacgctctcggccgcggaccgcctgccgcacccccacggcaaggcaagcaagccggcggcgtaagaccctggccagccgggcgaaagatagtctcttgcaacgtccgcgctaccgtgacgcccctgctactgcagcgtctcgctccgcttcgctgcctccagcagcatctcgcggcgttgctcggccgatagctcttcgtcggccacggccccggccgtctccagcagcgtccccagttccaggtcccaaaggcgggccgtgttgtccttcacgttgaacgtctccccgctaccggtgatcagccacttgccgtcgccgctcagcgccagcgtgttcaccgggcccacatgaccccgcagaacccgggccgtggcgaccggatccgacgccgacacatcccacagacgggccgtgcggtcgtagctgcccgatacgagccaacggccatccgggctgaaggccagttgttgcacgcgggcttgatgcccttggagtacccggctcgactcggccaccgactcggcctgcaagtcccagacgcggaccgtcttgtcgaagctgccgctggccagccagcgcccgtcggggctgatggctacggtacccacccagccctcatgcccgcggagaacggtcggatcggcacccgggtcgatcgcgctcagcttccacagccggacggtgttgtcgtaactgcccgaggccagccagcgattgtcgggactgacggccagggcatcgacccagccctcgtgaccgcggagcacgatctgttcggcggccgggcgacgggcagccagattccaaaggcgaatcgtcttgtcctcgcccgcagtggccagccagcgactgttggcactgacggccacggtgagaatcgggcgtcggtgtccgcgaagggtgatcggcgcccggctggcggcgggcatgctggcgactggcattccgtgcggattcgcgtctgccggcgtggacgtgtccgccgacgaggcctccgataatcccgggctgcccgccacacgggccccggtcacggcggccagattccagagccgggccacgttctcgccgccgcccgcaccgtcgtccagcgggtggcctcccgcctgccgcgaggcgttggctccgcccccggcggtgatcagccactgcccgtcggggctgatcgtcgccgcattgatccgaccctggtgcccccgcagcacgatgggagccgccgaggggtcctcggcccgcagattccagagcatggcacgaccgtcgtgcccagccgaggccagccacttcccctcgggcgtcatcgccaacgcgctaaccggaccctgatggccccgcagcacgtggcacgcttggtccgggctatccgcccagaggttccagagccggacggtggaatcggcgccggcggtggccaaccaatgcccctcgggactgaccgccgcgtcgagaatcggcccgctgtggccgcgcagcccatggggtcccacggcggccagggcgtcacgcacgatctgctccaacccgcggccaatctggagcccctcgcgctgccgggcgcggatcgattcccgcgccagaaacagcgcgcggtaggggtgcgtggccagcaactggcgcgagtcgtcggccagttgccgagccagggcgagccgcgcgcgccgcgccgtttggagctgctgtccctcgacgatcctccgtcgccgctccgcctccaggcgttgctcttccgtgcggcgaagctgatcctcgatggccagccgctcccgccgctgggtttcaacctgacgtcgctccgcttcgatctgccgttgccgccgagccgccagtttcgcgcgatgctcggccaattcctgggcaacctgacgttgctcttccgcccgctcgcgagccgcggccaactgcttcagcctgaccgacgtgtaggcgtagcccaaaccggctcccagggcactcaacaccagcaaggcggccaccagcgagacggccgtgctcaacaccgcatgccttccgcaccagcgacgcagccgctgccagtcggacagttgcttcggatggatcggctcgccggccaaccagcggtccagcgtgccggccgcgcccccttgccctccgttgaccgggcgaggcgaacactcatgggtgaaatgcatgccacacgccccgcaggtcagctccacgggcgtctcgccggcaagtgtctcgatcgattcggcgcacagcgggcaacgggcccgaacccggatacgcggcgccgccgccgtcgcccgaatcggcgagccagcgttggcgggttgatgtgactgggtggacatgggcgggctggggttcgcgggggagggcactcgctggacgcgaccaaccggcgggccgcgccgatcgccgtgcccctaacgtggcctcgtgctttcgcggtgagacgctctgggcccccaccggccgggcaaccggaaaatccggcatcggccgaacaggggctacaacagtcagatcggacaccaccggccaaccgacccggaaaacgggcggtgccagtacagcccgcacatccggaacatacgggaaatcgcataccatccgcgtcagggatacgaccgttgcgtccggtcggcgaagcgtggccgactttaccgcccggccgagccgatccagcgcgtccgtccaacttggagggcgtagcgcgcgacgccacccctcgcggaccccatttttcacgccttatttcgacgccgcgaatttttggataggtaaagccctttcttccgggcaccggggggccaccgaacccctcgccagacggccaggcttgcccctgaaaaccgggaataaagcacttcgcaccccccgtaagggccgattatggtgccggaaaaatgaacgcgctctcaaaatgcctttccaaaaacccaaccctcgcgcctacttattagtgggcagggactccgttcccggcccagtttgcggcccagttgctcgcagcaatcatctggcagcggctcatcgggtgatttcgcaggacacattcgcgatggcgaaagaaaccggcatcccccccgaatcacgagtcgaccacgccgaattcgtgcgtctgctgaagcggcatgagcggcggctgaacggctatgtcttggccctcgtgcagaactggaacgatgccgacgacatcctccaggcggttgccgtccgtctctgggagcaattcgacgaataccgaccggacggcgacttcggcgcgtgggcctgcaagatcgcctactacgaggtgctcacctaccgcaaacggaagggccgccgcgcgctgcaaacgactcccgctttcgaccaggccgtgttggaagacatggcggccgccgaaaacaacgggcccgggcctgaaaaggcccgccggcgggtggcacgcgccaaaacgccccaggagcccgtctgaccgcgaccaccggccaacgacccaaaagccattgactaggccgaaacgccgcgacgcgacgccgcggacgatcgctttctagggcgtcgccccgaagtatgggcgaatggtgggggggctaggcgccgccagcccggcggcgtagcttggtctggcgtgggtgctgttctttgacaattcgagctttcaaggttgcggttgaaaagagccacgacaggcggctcgcacccggggattggacagttcccggcttactgcccggcgggtacagagaagcccgccacacggtcgcccgtccatgtggtgagtccattttgagaaacgctgctggccctgacctttcaacagccgttgcaacgctgacaaaccacagatcatcggctggcggtgggaggtttcaaccaacctgacctttcaacagccgttgcaacccacgctggccgcttgcagccgcccgtcaatcgtcgtttcaaccaacctgacctttcaacagccgttgcaaccatgctgctacctcgttaccagtggatcgccacagtttcaaccaacctgacctttcaacagccgttgcaacctgccgtgcctgccggcaccggcaccacaagaacgtttcaaccaacctgacctttcaacagccgttgcaacgcgagtctcccacgctctacgccgagcacgggagtttcaaccaacctgacctttcaacagccgttgcaacgtctggccaactgcgatagtcgtccttggccccagggtttcaaccaacctgacctttcaacagccgttgcaaccaaaatctgcgagattcgcggaaagacagtaagtttcaaccaacctgacctttcaacagccgttgcaaccgcatcccatgtcgcggaggtgccgctcggcttgggagtttcaaccaacctgacctttcaacagccgttgcaaccccccggcacataacccatttgccggtaggtgcttgcggagcatgttccgcgaacctatggctcgaaggggtaacgatagctcgaatgaaaagcatggcgcgccgtaacttgaagcagcggcgagggttccgcgaatcgcgaacctcccgggtttggctgcgcgcttcgggttcgcggagatcggtctcatgacccataccctggcaatcgacttcggcgtccgtaatatcggcttggcgttggtcgcacatggagacgaccgccagccggctaatcgcattctatacgcggcgaccgtcgtcgtcgatgcaaaatggctcaaccaagccgtggccggtcgcgttgcggcccgagggattcgacgcactcgcaagacgcaccgccgccgattgcagcgactgggccaagccctcaaaggactgcccgaggcagagcacttggtccgcttctgccggcgtcgtggttacagctacgacccacccgaggaagacgacggcggccagtcgttccacttgccgcggggccgcttcttcgacgcactcaccgatgagatcgagcggacgatcccgcccgagcaccgccagcgcgcgttgaagctatgccgaaagcatctgaatgctggccggcatcgggaagccgaactccggcccgcgcgcttcgaaaaccgcaaccgggtaaagtgtcgctgggcaggctgtacgcgtaacgtcccgcgggccggcaacgatttccgcagccgcctccaacaagcgctctatgtttggctgaaacccgtcttcgaccaaacggagaatgcggcccgcctgcgccggtcggtcgatcattggattggggagcttgacggccttgccaggtggtgggccaaatgcgaacggctggacgcggacgcctgcaagcaagagcggaaagcggtcaccaagcgacgggggcgcgtctacaagaatctgctggcccggattgaccgcgaggtggccgaggatgctgccgagagatttcgcgaactttggaaaaagacctaccgcggcaacctgaacgacatcgtcaccggcaagcaaggtggccgctgcacctactgccgcaagcactccgatcagttcgtcgacgagttcttggctgggcgtcgcatcccacatcgggaagaaaccaccgaacgcgacctgattagccggaagcaacagatcatcttcgggcgcctgtggcgattggtcgaggcccggcttctgcctctggccggcgggaccattgaccgcgtggtggtcgagcgggtggccttcgacgtgctccaaggccgtcgcaaagcgcggcaggaattgccggaggcgcaagcggctgaaatgtattggtatgggccacagcgcgggtttacgtcgcggctggaaatgttgaaggccgagttcgacggcaaatgcgcctattgcagcgcggaagcggcggcggaagtggagcaccttttgccccgtgctgaattcccgctgaactcttacttcaatctgctgccggcatgccgcgagtgcaaccgaaagaagggatcgcgaccagcttccgccgcgcggatgcaagtaacacccgaggcggtcgcgagctacagaaaatacgttgaccggcttcgcgttccccacttgttccacacaatcaaaaagggaatgctcaagttgctaagccgcggcggcgacctagccgtcgccgagcggcaactgggcctcatagcaaacaacctggtcggcgtcacaaacacacaacgcggtccgcgtccgctcgcgcgatacttggcaaccaaattggaggatacaacagggctgcgccccagtgtcgacttcaccgccgggcgacatacggccctctatcgcgatgtattactgcccgccttcgacaagcccgccgcgaaagaggccggcgaattgaccaaccacgccatcgatgcgatcgtgctgggctgccggctaccgtcgcccaccgtgctcgaaagccagaagtggtttcagacgccgagcggcatccgtgcatggcgccgtaaagtgcgcgaagccgggcccgagttggccgacaacgtgccgcgcgtcgaagggccggagcccatcccgcacttcgaaaatgacctgggcggaggctacctcgcgctcgacctgagcgcttttaactggaaccaaaagcggaaatcgggccataggctcgatccgatcggcctgacaaacagcgatgagccgatcgaccgggaaccggccgccaaggtgctcgacaaactgcaacaggccaagagtcgagagggccagattgcgaggattgcgcatcccgccctacgcaaggccctccaggtcgatccagggcaggctgcggccgttttcgtccgctggctccagcaaaccgccgttgccggcttgaagggcgcccccatgagccgacacccgtccgaccggcagcgcgaacaagtcatccgccaattcgccgaaacgcccgtcgaagccttcctggcaaaagaggcgactgcggacctcccggggatcatcggcgtgcgctgtttgaaagccagttccgccaaggtcttcgacgtggtccgctgcgatgcctccggccaagtgttccaacactacaagagcgacccacgataccgccggttttacatcggatacaaggcaacgaaagcggggccgaatcgcgcgaagccgatcatctattgcgtcaatcaactctaccgggtgtgggaacgcgtcggcgcccgcaatcttgaactagacttcccggccgacagcccacttcgcggccgaccgctcggatcaatcgaaaacgaaaaggcgtttcttgcacgctggcaggcggcattcgatcaactctgccaggaacagggcatcgcggagcggtttgcggtgcatcagggggccgttatcgagaagaccgacgggagccaccttcaggtgcgcaacttcgacaacggcaaaccatggatgaaggcggacacgttccgccacattagccgcgtgtaccgctcaccgctgcaattcgcggccgagcatcgggtcgaaagtccgggctaattcgccaccgaccgggccagaatacgcgctccgcacctacctggcgcgactaccgccgccaggtaggaaatggaccgcgccgcgtcactccaccgctagcgccaattccgcgagtggcacggacactctctccacgatccagggccagcgcacactaagtgtgttttccggtaaggacttgcatcaggaagtcgacactccaggcggccatgcggcgtttcatgatattgctttccttgccggggtgttgcttgatcaggct

SEQ ID NO: 105 - DNA, 3086 bp, synthetic construct
  misc_feature 1..3086: note = Synthetic
  source 1..3086: mol_type = other DNA
tcagctatccttcgtgccgcgctgaacaaagccaccacccccgcccggatcggctcgggcaactcgccccaccgttccaggccagcccgaaccggctccggcagcgattgccaccgttcgatgagtgccgtcaagtcggggccagaaacacggtcggccgcgtttactgcccccgtttctgcccccatgtcactttcgacattctgtaagacgttagggtctttacacttatgactcgaaggcggctgattctcagtccgagaacgggggttcgactccccctgggggtgttgtgtaatttcgtaccgtatcgcaaggcgatgcacccgcaagcacaagcccttggtcttcaagggcttgttgcgtttcttgcgaagtccggatccgtcacctgcaagcagtgggcagtcttcaggaccgggtagccaccgaggaaggcccgcgagtgcgggggacttgattgtacctttgtgtcgggtatattggcgggcgcacgtggggttctttggcaattgaatacgtgaatactcaagagcgcggctgaaaagagccacggccggcgatcagcacccggggatcggacagtccccggccctgcccggcagtcacggtgaaggctgccgaaatgacgccggcccatgtggtgagtccgacttttttccactggggtaaaactctcctcgttttgccctggcattctaagacgaggggtcgcggcgtgcgatccgaggttcggggagggtagtcaccttgagttgttcttggccgatgcaagcgcggccggcgtgaagtcgcacgtccagcagcagtttcagtcaccttgagttgttcttggccgatgcaaccccggcaatgccgtcatagcaacggcctccgtgcagtttcagtcaccttgagttcttcttggccgatgcaacctagaacctgtttcccaagatcaaggagcaaagtttcagtcaccttgagttgttcttggccggtgcaacaacgcccgtggtgtcacttctcggcccgcttctggtttcagtcaccttgagttgttcttggccgatccaacaacatccccgcaatagcgcgggccgttcccctcggtttcagtcaccttgagttcttcttggccggtgcaaccaggtgcatccccttgcgggccgatacgctggatggtttcagtcaccttgagttcttcttggccggtgcaacacgtatgagctatctctttcacagcagtaggtgggtttcagtcaccttgagttcttcttggccggtgcaacggcaccacccctaagctgttgacaacatgggggttggcggcccgttttcgcggacctcccgctcagagcggccaagcggcgtttggttgtcgagaactccacgtgcaattgattttcagaacaggctttagggcaatcgcgaacctccccgggtttcccaggtcgcttgcggtccgcgggaagggcggcagcgtatgccctgtaccttggccatcgatttcggctcggcgaagatcgggatcgcgctggtggagcacaccgaggcagtgcccaaccggccgctctacgcggccaccttggtggtcaaccccagagggctcagcgaggccgtcgggatgcgcgtccaggcccgccgcatccggcggacgcgaaagacccaccgccgccggctggaccggctggcccaggccctccagggcgttgccggcgcggaggagatcgtccgcttctgccgccgccggggatatggtcacgaacctgaggagtcggatgcccagacccgagcgctccaggtgtcgcgggaggcgttctttgccgcgcttcgtgtggagatcgatcgggtgatcgccccggccgatcgcgcccgggtgcttcagatttgctcaagacatctcaacgcggcccggcgccgggacgcggaactccgcccggcgcgattcgagaaccgcgggccgacgaagtgccaatgggaaggctgtcggcgcaacgttccgcgggccggtaatgacttccaggggcgattgcagcaggcccttttcgagtggctcaggcccgtctttgaccagtctcctgaccccgcccggctccgccagtcggtcgatcattgggtcggtgagctggacgccctcggccgggcctaccggaagaccgaaaagctcgacgaagaggccggcaagaagaaacgccgagaactcgacaagcggcgcaagcgcgtctacgcaaacctcaagaagcgggtccgcgaagaggcgcccgaggagacggccgacgactttgaagagaactggcagaccacctacagccgaaacttgagggacatcctcaagggcagccaagggggtcgggtgagctactgccgggagcactcgcggacgttcgtcgattacttcctggccggcaaagtgccgccccaccggatggaagtcaccgagggggacttgatcagccggaagcagcagatcatctttgcgcggctctggcggcttgtggaagggcggctgctgggcatcgcgggtgggcggatcgaccgggtgatcgtcgagcgggtggcgttcgacatcctggccggcaaggccaaggcccgccgcgaattctctgagtccagcgccgccgaaatgtactggcacggaccgcagtacggattctccgaccgccgcgaaatgctggagaaggaattcgacggccgctgcgcctattgcggccggcaggacgggctggaggaggtcgagcacctcttgccgcagagccggtttccgttcgattcgtatttcaacgtcctcccggcgtgccgggcgtgcaacacgaagacggggggcgcgcacggcctcggaagccgggatgacgatcgccccggaagcctacgaagcatacgccgcgtatgtgggcaagctgagagtgccccacctcttccacacgatcaagaaggggctcttgaagctgctctcgcgggatgggcactcgacggaggtcgagaagcggctgggaatgctggcggacaacctggtcacagccaccgcgtcgcagaaatctccccgaccgctggcccgctacttggcgagcaagctggagcgccagacgggatgccggccgcaaatc

SEQ ID NO: 106 - DNA, 6796 bp, synthetic construct
  misc_feature 1..6796: note = Synthetic
  source 1..6796: mol_type = other DNA
ctttagtaagatttaggtcacctaatttgttcggaagataattgtaattattaccagtgctgcaatttatgaagatgagaagggctatcaaaattaatgcgaaaatgtttttattcacttttttgaacatattgcctttttgatatttcatctgtttgaatagtctctgaaaaatttgatggccaagctctgtcataaattttcatcaatcggcttaatgcagtttggatcattgtttttaacagagtttacaaattttgatactggataatatttcatatcatggattaagccatcttgaaggataatttctaattcttttgggtcttggatatcgggattcaaccatttttcatggaactctggatcaaggattgctggcatacggtgatgaatactgctgatggatccactggcttcgcttgttataatcgtacaggacttataaacagattcttcatcacttcctttatcaatccatgtttcccacaaaccagcaaacgcaaaggattcaccggaaggaatggaaacatagtatggttgcttgtgtcctttttcacctttccattcataaaatccatctgcaggtattaagcatctacgttttctgaaggcatttctgaaactcggtttctctgcaacagtctcagcccgggcattgatcattctggaggcgatggaaatatcctttgcccagaacggcaccagaccccaatgaagcttttcaagtctgtttttgttgttatgttttataatcgaaagaatctggtgggtgggcgctacattgtagtttgggataacttcaaacaataccgtgccgatattgaatatctgctgaatagtttgcaaaggactgtattgaacaaatcttccacacataggcttcgctttttaaataaagttactgatggatatttttaatcggagttcaaccgatccctcaacttaccagaacacctaaacgtaacaacttttcttggttcaagcatcaggtcatccccagtagccggattcctgcctttccgttcccttttttcctttacacagaacctgccgaaattggagatcaacacatcctcaccggatgccagtgtgctcttgatgatctctaagagggtttctacaatgtctgtggatttgttcttgggtaaaccgagatggttctggatcaattctacgatctgaatctttgtaagtgccatggtggggctcctcatgtattaggttggaattataagtcatttatctgaattatgagaagggatgtcaaatgcaaagccttaactactactatgtagtatctttagtagccacttgacattttgggaagattatgagaaagaaaggatcgagaaagatatctattatcaacaggttaacttataagccctattctggtctctttcctgatatctcacttgcctttacctgctgttaattcaactttggcttgccttggtacgttgccaatttgatcctctttatcctgaaacatagggagaacatatgtgactattttgaaccccatttctcagatagagaggtggggttttgtcgtttttcaagaatagaataacttgatatgcaacagactactttatcaatagactttggttcaaaaaacatcggccttgcactggtgcggaatgagggtgataaaaacatacctctattcggaggaactttgagttatgatccagtgcagcttaagaaaaaacttaatccacgacctttactccgcagaatgcgtagaacaagaaaggcccgaaagacacgacttcgcaaactgggacaggggcttaaatctataggtttggatgaaaagttgataatacagttagtgtcctactgtaagcgaagaggatggatttcgctcttcggcaacaacgaaacagacgtgtacagaaccaaggatgatggagaaatactttttgggttttcccgtgaagagttcttcaaagcactggaaaaagagctattagaaaaagtaccatcagaaaaatataaaaatgccctcagtgtctgtgagaacgtattgaacagatacggagatccacataaagaggttcgtctcatccgtattgataatcgtggggtatcacgttgtgcatgggagggttgtgacagagtcacgcccagacgtgataatgctataaaagatgctttatcccagttcgtatacgtaatcatagaccgagatcgccttcttaaggaagacggtcttaaacaacagcttacggacactttggatcgactggaggaaattggaaagcgacttcggaacgctggaggtagaaatccattaaaaagagatccccaacaggtcaaagcagaacgtaagattcttttgaagaggaggaataaagaacttagactgattaaagaacttagcaatgatgatacatggtcaaccaatagaacaaacatcattaacatccttgaaaaaagcagaggacgcaaccgttactgccggaaacacagcgcagagtttcttagatactggatcgaaggtaaggcagttccattcaacagatcacttactgagaaagatattatgtctcggagagaggaggtgctttttcagaaactgtggaggtacatcgaagcaagacttttgcctttaacgccaaatggcattgatcgattggttgtcgaacgggtcgctttcgatctcttggcaggtacatggaaacaacggcagaagattggtgataaagcacttgaagagatgtaccaacatggccctcagtacgggtttaaaagcgtactggatatgctaaaggaagagtttggtggactttgtgcctactgtggcataaaaaccgatagcatccttgaactggatcacatgcttccaaaaagagatttcatatttgacagttatttgaacttggttcctgcatgtcctacgtgtaaccgtcaaatcaaatcgaaacactccccgagatcagcgagacttaccataagcgaaaaagcctttaaggcttatcaggagtatctccaaagtaagtttaaaaacaaagcacctcaccacctccacaatattaagaagggtattttaaagttaatgactgatccggaaagatcgtgggaagcggaacagtatcttgccctaattgccaaaaactatcttgaaattaccggaacccagagaagtccccgaccacttgcccgatatcttagccaaaagctatgtagcaaatacggtgcatttccaaaggttgttttcaataatggacgccacactgccctttggcgaaatgcggcctacccggagttcgataaggttaaagataaaatttcaggcagtgcgattaatcacgctatagatgcgatagtgttagcgtcaaagctaccaagccccacactacttgaggggctaaatcttccagttaaatccttgaaatcatggactaacaaagtgcaaaagactgctccaccctctggatcagaagggatacctgtcatgcctgagccaacttttgcagtaccgggctttgaacatatccttccgggtaactatgtccaaacacatctatcgtttctaaactggaacagaaaagacacaagggttcagcgacaagacatttatggctggaacagatatcaagatatgcctacaaggcgaaccgctgcttcagatctggtagaaaagtttttaaaagctgacaaggaacacactgaagatactaaattaaagaaaatttccagagaagtgaataacattattcatccacacctaaagaatgtccttagatctgaaatgattaaagactctcccggagaagcatgtgcacgtgcactgaccggttggctcagaaaatcaataaaaggttctcttccgaaatcacacttctcaaatcatcctgcagatcagagcagaaagaagttactcaatgattttatcgaaggcaacattgatacaatacctgtcacaataggaataaaaatgttacgtccacacgataaaggtgctgtagatcttgagcgagttggaacgaaaaacggacacatcattcatcgttatcgaagcgatcctgctatcattgccaagatcgtttgctacaaggggaaggatgaacaaatagatcgtaacaaacccatagtctatgactggcgtcaaagctggaagctggttggaaagagtagcagggttcctgaaacaccagaagggctattaaaggggcgtgcgtttgggcagtctcttcccaaagagaaagattggttttcagcgttagataagtaccttggggaagttggtttttcagattacgcagtagttagacaaggatgtgttgctgtgtatgaagacggctctcagctatacattcgcaacttttcatctactcaaggattcaagcaaagcatgttaaaaggtattgtcggtatacgaagctcaccctttgttgacaagaccgtgatgaacagggtaataagataagtaggtagcgtaactgttctttgacaacggaatagtagtgaaggttggaaagagcatctgaccgagaggtgcactccgggttattggcagatccggctcttgctgcgtccttgggccattggcctctggacgaaccctttcggcatgttttcggacaagatgtgagcctttttactcagcatcacctatcgacttgcaatgtcgatgtaactcattacaagacttattgaccgggagtacaaccgggttccaatcacctatcgacttgcaatgtcgatgtaactgataaattaacaggttcaagcatcggctcaacggttccaatcacctatcgacttgcaaggtcgatgtgaccccttttccaaaaccacatagtctgttaattcctgttccaatcacctatcgacttgcaaggtcgatgtgacactttagaggtgtttaccggagcaccataatcatgttccaatcacctatcgacttgcaaggtcgatgtgactgctattccgtttttactttttttatcggttggttatttgagtgtttttgcgaaccccaagtttattaacggtaacctcaacattgtaagatttcaattagaaaacatctaactttttcatctggttactgatttgcgaacccaccgggaatttgctgcccactcgtggttcgcatgagaaatggttccctgtttaaaaatgacttgatatttaccaaatagaagaccaaacccatgaaagacttattaaccaaaatcgtacaagcagtggtcgacaacccggaacaggtacagattaatgaaattgaaggtagccagacaactgtattagaactcagagtagctaaggaggatataggaaggatcattgggaaacagggcagaatggccaatgctatccgggttttattaaatgcagcttctggaaaggctggaaaaagatacatggttgagattgttgaatgatgttgagggttaaggagtattttgataactttcaaaaaatagtggatgaaataaatcatggataaagcacacaccacaaaatacaataccaatcttgcagcagagttccatgtcctttcgattttgcaccggcttggacttgaggccacactcacacttggaaacaaaaaggccgtggatatattcatcttcaaaccggacggaaagactctaaccatcgatgttaagggtgttgcaaaaaagtctgactggcctgccgataacctgaaggttgatggcaagagaggccactatatcattctggtgtgctttaatgcaaagattgcagaacctaatgagcctccctctgtttgggttgttccagccagagaaattaagaagttcaaaaagaagtacaaaacaaggacggttgtttctcgtaaaaagatagttcacgaaggtgaggaatatcttcaggcttggaattctttaggttaggccagcaggtggattccacagtaccggcaggacagatatgaggtgtaaggggtgctcacatgaaagattttctaatccaaatcatacaagcactggtcgacaacccggaagaggtacaggttaatgcaattgaaggtcgccaaactgttgtacttgaactcagagtggccaaggaggatatggggaaggtcattgggaaacagggcaaaacagccaatgccttccgggttttattaaatgcagcttctggaaaggctggaaaaaggtacatgcttgagattgttgagtgatgtggtgggaatgaattgagacaggatagtttggatttgacgatggtcattatacaatatctgtattaagatcgatatttagatactggcaagatgaaatttgaaggcatcacattaaaaaaaaccaatttatcaaatcaataaaaggggggtaaatggcaactgcaagaataatatttaatagatgtattcaagattctcaagagtatggaagtgatgatgaacatatgatttcgagagtgtttttcactcttgaaattggtgatagaagaattgatttacatgccgacataaagcaggctgttggtagtagttatgaaaaaggcctaatcgaggttggcatgcctgaaggacatcggggacccttcaattatgaagtttttcgggatgctgcagaaagatattatcggagtttagttggttctggagctggtgcaataaatattcaaggtggaaccaatattcgaatgcaaaataatacatttagcaaagtaatgactgtcgaatgtgaaatagacgaaacttcaggaggttggtagattatttacaagacaaaataaaacataacaaaaaagtgctcttgaattcgtgattcttcccttgcttcccctatatgcatccccatct

SEQ ID NO: 107 - DNA, 3340 bp, synthetic construct
  misc_feature 1..3340: note = Synthetic
  source 1..3340: mol_type = other DNA
ataacaccaaattgaacgaggttcaatagaaaaaacggtgctacgtaccaatctttttttctaccgcgcagcggtttagttcttcaaacaggaatgaacggcagaggcgagccgcaacttttctatcctgcctgtctccggtcaagcgacttttcttaagcaaactcacaccttttcaagtcttcagatttcccttgactttcctcgccaacttgatagactactctcaccaaccttgagttagtatcgctgagttagcgtttccaagttaacctgacaacctaaccctcaaccttttgaagagtgtcagctcttatcgtttggatcgaacaaagtggctcccacggatgaacctattgtgaaatccatgatcacgctatccattgatttcggttccaagaacattggcgttgccctggcaagaaaccaggaaggaattaacactcctttgttcgccggaactctcctatacgacccctttcagctcagcacaaaggtgggacccagggcgcaattacgcagaggacgccgcactagaaagacaaagagataccgcctaaatcgtttggaaaagaagctatctgcaataaaccttcctgacgaaacagttcggcaacttatcaccttttgcagacgccgaggatactcttctctttttgatgaacctcacaaattagacctcgaaaaaaaggagccgggagaggagatcgtttttcgtttcagccgagaggaattctttggagtattggaaaaacagatcgataaattcgtacccgaggataaaggggcaacggttctcactttatgcgaagatatcctcaaccgcgctggcgatccttccaaggaaatccgtccattaaggatcgacaaccgaggagcctcccggtgcgcctgggacggctgtgataatgtccctcctcggagggataacgccctccgggaccccctttcccaattcgttcatacggtatttgcttcaagtctcaggggcgacacagccctccagcaagaggtctcaggaatgttggaccgcatcgcgatattgggaaaacggctccgccatcgcggaggtccagacccagataaggagcgtaaggcccttaagtcagaaatcagcgatgaactgaaactgttgaagaagctgtatggcctaaaccctgatttgaccgaagagacggctactccctggacaaagattcggcagaacataacgaacctgatagaacagaccggagggcgtaaccggttttgtcgccaccacagttctcaatatgtcgcccacttcatggaaggaaaaccgataccttttaaggcaaccttgaccgaaagggatttagtgtctcgccgtgaagaaatcctttttcaaaagatttggcgctatattgaggcgagaattcttccgcttgctcccgatggcattgaccgtgtgattgtggagcgaacagccattgaccttctggcaggtagccgcaaacagcgtcaagggattatgaataaagaagcccttgaggagatgtatcagcatgggcctcgatacggatttgagaacgaccttgaaatgctgagagctgaattcgacggtctgtgtgcgtattgtggcaagccaaatgccgaattggttgaaagagaccaccttctgccccggtccaaattcttcttcgacagctacctgaatatagttcctgcttgcccaccctgcaatcgaaccttgaaacaaaccgcttcgccgggagaggcagcactaaggattcatggacaggcatacgatgcgtattcaaaatacatggctttgaaatttagagataaaccacctcatctgtttcataccatcaagaaaggcatcctcaatctcatgcgggagcctgaccgcgtctgggaggcagagcggtatcttaacatcatcgccaaccagtttgctcaggtcacaggaacgcagcgggggccacgtcctttggcccgttatctcagcggaaagatattccagagatacggtgagaaaccccgcatcggttttgtcaacggaagacataccgccctgtggcggaaggctgcttatccggacttcgacaaattcagggacaaagccgaaggtggagtcatcaaccatgcccttgatgctctgcttatggcctgtgaccttccggatttgaccgcgctggaggcaaggaacttacagccggggttgatgcaatggtgggtggacaaagtcaagaaggcagccccgcctcaaggtcgggaaggagtccctgagctgcttgaacctaattttgctgtgcctggatttgagaacgttctacctgggaattatgttgaagccgatttggcgaagatgaactggaaccacaaggattctcaagttcaacgccaaggcgcctacggttggtcaaaactgcgcgatttacccgttcagcgtgtcacagccgcaagtctgacggatgagatcctccaagccgacaggaagacaactcctgagtcccgcaagtctgaggtcaagaagaaggtggatttggtcgtccatccaagactccgcaaagcgcttgaagaagcgaacaatggcgataccccgggagcaatcacagccgaggtgctcaaaacctggttgaggaaatcaatcaagggaaatcttgataaagcccatttttcctctcacccggcagaccagcgcagagcaaaaatgctccaagattttctcagcgggcaatctgaaggcatccctgcggtcataggagtcaatacttttgtgccctcgttaaagtccaatacggatttgaatcgaattaaccctgcgaccggtcatgttatacaccgatatgttgccgaccccgcaaatgtggcctacatagtggcctaccagaagaagaacggtaaggtcaaacgggataagccattgacccttgagtggcgccagagcggagccgtcatctctgacagtcgtctgtttaaagaagttcgtgaaaagccattgatgggacgtgcgctcggagagagagcgaccgaccagaccgcttggaaaactgctttacgccactatttaaccagcgcaggaatagctgaatacaatttcgtttctcagggaaatgtggttgtttatgaagatgggagtgaacgatacgtcagaaacttttcgggcagttatgggttcagaaagtcttggtttaaggggatgacagcagttcgaccttcaccgctgaccaagcgtttgattccaaatgcaacactttagaaggtcttgattccgttctttgacaactggatagcgttttcaggttcaagctgaaaagagcatctgtccggaagggccactccgggttagggcagatccggcacttgggcctccttg

SEQ ID NO: 108 - DNA, 7646 bp, synthetic construct
  misc_feature 1..7646: note = Synthetic
  source 1..7646: mol_type = other DNA
cgcctcgacgacgcgttatacaaatcgcgagtcgagcaggaaaaagccggattaagtcgtgctgaagccgagttggcgctggcgaaggtcaaatatgaacgggcgcagacacaggaaaaggtagggttgcctaatgcggatcaagtccccaaggcagtcgtggatgcggccgaagcggccgtggaacaaagtaaggccgcgctggaacaagctcaaatcagtctcaaccacactgtcatcaagtcgctggtcaacggggttatcgtagatcgccgggtgaacgtgggccaaaatgttgcaccaactcccaatgcgcccaccctgtttctgatcgccaaaaacatgaaaaatatgtatatcttggcctcggtcgacgaggccgacatcgggcggattcgcgatggaatggcggccagtttcaccgtcgatgcctttcccaacgaaaccttcataggcaaggtgattcaaattcgcaaagatgcccaaagaactcaaaatgccgtgtcatataccgtggtattaagcttcgacaactccaacctaaaactcatgccttatctgacggcgaatctaaagttccaggtcgaaacccgccgcgatatactcctcgtgcccaacgccgccctgcgctggaaaccccggacggaaatggttgccccagacgctcgtgagtcggatcaaactgctaaagataaagataattattgccgcctctgggtgaaagaccctgacgggcagcatgttcggcaaattgatgttcaaaccggcctgaccgatggcacgatgaccgaaatcagcagcccggacgtaaaggaagggatggaagtggtgatcggcgtggcgctgaagggcggcaccggacatggcccaaccattaatccctcctaccgcccggagggcttcaaacagccggcaacgcagcagtaaccggcaatcactgcgaatcctgccggcgccccgaccgactaatgagagtaagcggctctccacgtattgctcccctatccgggcaccgacgggcaccatcgggcaccgacggggcaccatcgggcaccgacggggcaccatgcggagcatggtcgcgttggtcggcatggtcgcgttggtcggcatggtcgcgttggtcggcatagtcggttggtcgcgggagaggggccgggggtgagtgcccattgccttccaaactccaaacttattcttaaacagccgctaagtcccggcatcattatatcttacaaaaaaggggtggctgaggggacttgaacccccgacttccagatccacaatctggcactctaaccaactgagctacagccaccatgtcccaatcatatagacgctattatatatgaattgttcattgagtcgtcaacacatacaccggcattgggctttaagatggataagattttcctgaaaaaaggcaattatcggccggaaatgaggggcgaggggataggggcgaggggctagggaaggatgatcatatagaagtaaagagggaaaagatcagattgtaccccgaacatcttaatggcattcaagggcatagcttggggttgacatttgtgttggaaagtctatctttagggatacatacatacagactgctctttgacaatacgaacattaggtggtgactgaaaagagccacagccggcagccagcacccgggaatgggacagttcccggccctgcaaggcagcacagagaagcgtgccgaaatggcgccggcttatgtggtgagtccatttatttttattgataaaggcacacagccaacctgatttttcttctccgttgcgattaatgaccggactcttgagtaactggtcgagtgagtttcagccaaccagatttttcctctccgttgcgattgcccgcaaccgatgtcgtcagcggtgtcttgatgtttcagccaacctgatttttcctctccgttgcgatttgacgttcgcaagttccaacgtataatccgttgtgtttcagccaacctgatttttcctctccgttgcgatttgcgctgaacagactgatttggattgccttaaacgtttcagccaacctgatttttcctctccgttgcgataccagcgtgctggtcgctgtttgttccagggtcatgtttcagccaacctgatttttcctctccgttgcgatccggcggcccttgtatcaacgtgccgactactatggttgtttcagccaacctgatttttcctctccgttgcgatgcgtactggcgtgagaagtggcatacagcggccgtgtttcagccaacctgatttttcctctccgttgcgatggcacccctcgttaatccttactagcgactaggttacgagttggttttcgcgaacctagccattcaatcgtagaggaaatgttcgcattcaaagggccttatgcacaaattgttcgaagatgtatagttacgacaaacgcgaacctaccgggctttctgcaaccactggtggttcgcgaaaaggtttccgtgacatgtcttgtactctggcaatcgactttggctcaaagaacatcggcatcgctttggttgagcatactgagagcgtgcccaatcgcgttctatacgcgggaacgatggtggttgctgctaaaccactcaatgcagccgtgcaaccccgagcactgtcgcgaaggatgcggcgatcaaggaagacccatgtcgggcgtttacgccggttaagccaggcgcttgccggcaccgaaggcgcacaggaaatcgttcgattttgccgccgacgaggttacagccacgaaccggaggattcggatgaaagcgcccggggaatgcatttttcacgtgaagatttctttgatgtattacggcaagagatcaatcgcgttattactccagaagaacgtgacagaacgttgcgggtctgctcgaaacatctcaacgaagcacgaatacagacaagggaattgcgacctgcccgatttgataaccgaggacctacaaagtgccaatggataggctgtcgaaagagcgtgcctaaggctgccaatgcgatcaaagagcggattcaacaagctctatatgcttggatgaaaccagtcttcgatgaatgcagtaatccccaaggacttcgccattcagtcgatcattggattctagaacttgatggactggcccgctggtatgccaaaagccagaaattaaatgatcaagcccgcaaggaaacacaaaaactcattaacaagcggaagaacctgatatataagcacataaagtcgcgagtatgtcaggaagtatccgaagaattggccgaaaagtttcgtgagaactggactgagacatacgggagcaatattacagaaatcattaccggtggacagggcgggcggattcgctactgccgagaacactcgaatagcttcgttgatttctttctcgcgggaaagcagattcccaatcgaacagatataaccatggccgacctgtttggccgcaagcagcaaatcctgttctcgcgaatctggagactgttggaagagcggttgctgcccttggccggcgggcagattgatcgagttgtcgtggaacgggtggccttcagcatacttgccggaaaggctaaggatcggcgggaactttccaaggacaaagcctcggaaatgtacaggtatggtccacaatacggtttcagcgatcgccgagaaatgttcaaggaggaattcggcggccggtgcgcttactgcggtcaaactaatgcgataaatgaggtggaacaccttttgtcgcgaaacgagttcccttttgactcttatctgaatattctgcctgcttgcagcgcctgcaatgccagaaaaggcgcacgtacggcatttgccgctgggatgacgataaatcgtgatgcttatcaagcatacgccgattacgttggtcggaaaaagccaccacacttgtttcacacaatcaagaaagggatgctcaatcttctttccaagaatggcaactccttggaagtcgagaaacagttggggatgctggcagataacctggtgacgataagcgctactcagaaagggccgcgaccactggcaagatatcttgcaggccaacttagcaaggtgaacggatacccctgcgagagcttatggatttctggccgccatacagccctttaccgcaagattcttctgcctgaatatgaaaagcaagatagaaaggcggcacatgatttgatcaatcatgcggtggacgcaataatcctgggctgcaaactgccttctgcggctgcaattgagaatccccgttggtatgcccgtgcacgcgatatcaatgattggcgtgataaggttcgagccgccgggccggcgctggaaaatggcataccccgggtagaaccggttacattcataccgttttttgagggagaaataggtaacggctactgttccatcgatctgagcgcattcagttggaatcgaaaacaccaatccgggcacctgcttgatcccgtcgggatgacagatggcaaattgccaatcaagagagaaccggcaacggaggtgtttgcaaatctgaaagaccaaaggaaacgcgatgagcaaattaaacgtatagcccatcccgccctaaaaaaactgctggaatcgaatccaaaaggagcagcggaacaactcatacgctggttacagcaatcggttcaaagcggcctttcgagtggaaaaatggggaaccatccttccgaccaggcgagaaagagacttctggaggagttcgttaacagccctgttgagattttcttgaaagatgataaggatgggcgcaaagacattccacaaataatcggtatccgttgtcttattgccggatcgtcattttcgatgttcgatgttactcgatgtgatatgacaggcagaatttttcagcactataaaactgatccacacttgaaagccctttatgtgggataccgaaaaaacaagaagggtgtgcttgatctctcacggccggtcctattctgcgttaaccagatttacgcagtaaccaaaagggaaagtagtggggtacaagtcctagatatcaccgcagatagcccgcttcgtggtcgtgccttgggctccaaaggaagcttgaaagagtttttaggcagatggcaagtggctttcgatgaactttgtcgttctgagtatattatcaagcgattccgaatcactcagggatgtgtcattgaaaaaagagacggaacattttttcaattgcggaacttcgcccgtgacaaaccttggatgaaaggttctccgtttagaaatatccgccgagtgtatcgttctcctttcctgtttttaaagcaggcccaaaatatagtattagaagaacatcattctaccctgataccgattgatcaagtaattgagtaagtaggataccgtccaccgcccactgaccaccgcccactttatttctccgtgttcttcgtgccctccgtggtgaatacaaatctaatcttgtgccacctctaggcatagcctggcgaacaattgccctttttcatgaaaaatcacttcagccaaaaatcaggaaaaatacccaaaaataccaaaaatagttgaatatgaatttcctcacgtgtaacttttttctagtgtgtttgcccccatcgctcttcgcatctcctatttacacaacaacttgcttccagccccccagatggtttttctgaaaactcaaattctgacttttcagaaataattcatttccaaaaaactcttgtggaaaaattccaactgcttatcccgcaatacatttgcgcgcactgcaaccacagtcttttcactgatattttttaagcactaaaatgcctaaaaaaacggcaccataaccccttattttccaaccccttaatatctgtcctcttgaagaaaaatgccttttctccgtacacgcggaaaaactccaaaccccttcacgaaaaaactcccctttcttttacatcatagtctgaaacccggggtagccgctggcgcggcaaccccgggctatcctatgaaagcccttcgggctatcgaatgcgtgcggtttgaaattggaatccgtagaatggatctgtcttatcataagtccttcgggctagcccgcatttctcacagtgggtgggccggaggtcgcgcaagtactttacttgatgcgcggtgaaagcgcgcaaatatcaaacaaaaaatttattcatgtgcgaccacgatcatcgaatagagtcttgtggcaggcacgatgaaggacaccgattcgcccgattcctgaaaactcagcggggccggatcatccgcgtccggggaaaaacaggttacggattttacccggccgggaaattgcctgcgcagggcgacagggaaaggggcgagtttatttttgcggtcgaagttgatgaaatgagccatggtttcgcgcgtcgcgggccgattcaagagttccataaccgtggtcaatggggcctcggtagtgatggaagtgccttttggcagggcctcgactacggcatgaaagatttcccggtggtttttgggcagcacccactgggcgggcgacatgcgctggctcttcgacgggccggcgcccggctcggggtcctgatcgtcgaccggcattcttgaagagcgcgcgtcggcgcggacaatttccgggatgtatatgatgcggcccttgccttcgctccgctctggtagcaaggggtttgtgcgtcgccgttcccgccactggttatattgcgcggtgttgccggtcagaaccagggcgccgccgccgcggacatattgcagcagggttttgatctgggtgtcggaaacgcattcctgtccggccaggatcaccgcgccgtagcggccgatgcggtcgagttgctcctcgaacagcaagtcgaaggggattttgtactggattagcacctgctccattaaagtagcgggaaagtacgcggagttgatgctgtaggccatggaaggccaattccgcagcacggcaacgtcggccacgttgtcggttccggtgtagtagcgatcgttgtactgtcgaaagaactccatgatgggtgtgaagacgttgtgcgcccctgcgccgaacggtgcgcccgggtatccggcaacgggcttctggtagccaaatgccatgtggaccgcggcacgaagttcgtcgtgcatcgaatcttcgcaactagttcccagtcgccgggccattttgtaagagcggatctgggaaaccaaggcgccggtagccgggtctatgcgggcatcgtagccgccggtatcgaaagacaacacgtcgacgtgattggcgaacagcgggtggtagacggcattggtccagtatcgattgaagctgtaaaggcccttgatgttcagatgcaccaccacgttgggattaaggccctttacatagtcgtgcagatcattcgtataatttgccagcgactcgcagcggaatcggacccactcctggagcaccgggtcgtttagcgcggtcaggccatcgggctgtgtgggcgagtcccactcgctgacccggatccaatccacttccggcaatccgaagcggcgcattaccgactctttggtcgggtatcgctgcctgaggaaatcgtggaaggcctgtatgcatcgcgggcagcggcaggactttggct

SEQ ID NO: 109 - DNA, 17641 bp, synthetic construct
  misc_feature 1..17641: note = Synthetic
  source 1..17641: mol_type = other DNA
atatcctgacggaagccgtctcgtaacctgccaactttctattttcgccggttctttggcagcttgtaagttgaaattgatctggtgcccgcccggacgattcatgatgggcagcgcggcagccgaagagggccgtgacatcgacgaagagcaggtcgccgtgggattgtcggacggcttctggcttgggaaatttgaagtcacgcaaagcgaatggaaacacgtcatgaatacggagccctggaaaggccagcccctcgtgaaggagggcgacgactatccggccacccacgtgagtcgcgatgaggccctcaatttttgccgggtcttgaccacgcaggaacgaaaagccgggcgcatgccggcgggattcgagtacacgctgccgaccgaagcccaatgggagtatgtgtgccgtgcgggaacggcaacgaggttttcctttgccgacgatacgctgacattgagcgatcatgcgtggtgggggggcacaggaccgtgggggaatacccaggacgaagcctatccccatcgcgtcggtctgaaacggccaaacccgtggggactctttgacatgcacggcaatgtctgggaatggtgccgcgacgcgtacgtcagaaaactgccaggcggccacgaccccgaggtcgcagtagcgaccaaagaggacaggctcgccccctggcggcggtgcggcgggaattgcattggcacggcgaatttcgttctgcgcggtgggagttggaatcgcgcagaccactactgccggtcagcgttccgatatcgatttccacgccgcgcaacgctttcggaactgggctttcgcctggccctcagcgaggtcccgtaaagctcggatgcgcgttgtcaccgtgtttggcattcaacctcccatccgccggcgatagaatcaatgtgtgtccgccccggcaggtcgtacaagccccgagcactggcaattcccgattcggatgcccaaacggcggtggatattcctgagggtgtcgctggtcatcggagtggtcttctattttgcagggcaggatctgagtcgcattgagactggcgagaaagttcctcgcgtctcctggctcccgccggctgccacgaacgtctcgtactaccgttcgtacttgttcacggcgtatgaattcgacgtttcggagagcgagtttcttaaatgggcacagggatatgacctcaagcccgtccgagaaccgttctcgatcccacggtataacttcgcggccaaagcgctgcctcctgaggacgccagtgaggaggatgccaggcgcatctgggagcgggcgtcagttcgaacggccaccgtcaacgatggttatttctacgagcaggaacgtggacgaagcggcggcttcacgcgcattgcctgggatcggacgaccagccgcgcgtatttccagtcaaacccgcgatagccccttcggactcaccatgactgaatgatcggaagtcactgtgccgccccccgagacgcgcccggcgttgatccgattcgatctcggcggaagggctgagatggcgacggaagtggaattatggcgcgtagtagaccgcgacatggccgccattttctgtcggcacgaaaaggaagtgccatccattattggccggcaagctggaagaagtaggcgatttccgggcgaacttcgaaccaggacgattgtgggcctgcgaaccttgagtttgcccagcccacgcaaaggacgggccattaatggatcgcaccatcccgttatgattgacgtcggcctggcaatcgtcgcgacctggccgccgcgaccgtcgatcgagctggagatcatagcattcgcaacggcgacgacagacgggcccgccgagccgccggccagtaatccgccggttgtcgccgtggccgaggaaccgagcggcgaacagtcaacggccgacgatgacgcaaccgagccaccgcccgcggccgataacgacaaagcccacggtgaccggcgacgattcaacgggagggcagcggcggcacctaacccgacgaaagcggaaatcgccgaggcctgtttggaaattcaattcggctggagcgtatttgaagaagcatcccgccgcggcgttgacctgaaaaaaacgagctggcgagtgcaggcggtgcggtgcgaagcggtaattgaaggcgacgcgggggagtgattgccgattgttctatgacttgaaaaaaaatcccggaagatcaataccagatcgacttgcaataaatttgatagtggcagtgtcctcatcggtcggtgtgcgaggaagtataatatagaatttcgggtggccgcctacactcttttcgatgaaaccagcgtttggaaacgcagcttcgatagaacgaacgaaagtatcacgagccgtctcatcgccggcaaatccaaattcgaatctttcatttggaaaatcgcgacctcggattatcggttggcttatagaaactcggctttcaattctgtcgagacgttcaagaatgtatttcgaaatgtcatcttgacccgtaacttctcgcatgacctgcgatttcgcggcacggtaaaccggattatccggttctgttccgtccatcgccgcggcgactgaacttttcaaatgcttcgcgatttcctgaacgccggcgatgtcattcgtgtagaaaaacgttcgctcttgcgccaggtcgaacggcaatcgcgtcccgacctcggccagcgacacgacaggaagtcgcttgcagtgtctaaccgccaattcgtacatcacgttcgggttgagatgcgtcaggtttgctacgacaagatctgcggaaagcaatttctcgattacctgaatattgatcgagccggggtcagagattcgatgcgccacttcgaccgcgaaacccagctcccgcaagacgggttcaatcaccacgtcgataattccgtccgtagcgcggcgtaccgggctcgcatcatcgccgatcggagtgatgacgaaacaggttttccttttagtagccggctcgggagtcgcggcggccggcgacggcgcgggatcgtcaggcatggtcactctggcctattgtgtttcactggcggctaatggcggctcgtcgggatatgaaccgccaaacgcatcttttgaatacattcgaatgagaagcggttctaggatgttttcttttggaaccgttttcaagagcgcgaattcttcaatcagtggcttaaatttctggattccccattttgacaggcagttgtagagaatcaacacaagttcatcgcttgaaagctgcgctctaaccagattgacgtagaactttttgtcgtcgatctcttcggctctcttgacgaatttaatgatgttgtagagaagccgaaagtagtgaccgagggtatgttgccgcgaaatatagaatgtttcatatcgccgcaagaaatcaattggacggccttcgattgctgcttcctgtctcacttcaatgtggaatttatgcacccatgcagcgaagcatgctcgacctttatataaccgcccgtcgagagttagctcgatcgcattgatgatgtcgttatgcagcttgaggagttgaaaaaaagacgactcgaaactctgcgtgtagttaagcctactttgttctgcggctgttttcgatgaatcacttatttctttcgcagtaagtcgcagctcgtggatctgaaatgcgagcgttcccaagaggccaaaggcggtaataagaccgaaaagtggattcaggattcctccgacgtaatctccgaattgaccccaagtcgcgggatcagcagcgagatcatgaaatgttcgataataatcacgtaccacgaaaatgctcgaaacaatcgcgcacagcaagacgatcgcaaaccacatgaaagccgatgtcggaatgcgattcggctcagcactgctgtcgtcaccgtgttgcataatagcatcctcgattctgaagtctcgggtggactcccggcgaccagtctaccgccgttctcagtccctttccaacgaccgcgcccccggtgacaatccgtcgcatgtcgccacgtcagcgaacgattctcgacccggtgaacatgaagcggtgtcccgcaagatccgcttgcgattgaggagcgggaggcgtatgctggctgcacgattgcctgttcttttacaattcgacaaccgacataatcgcgtctgaaaagagcctagacccggacgagcacccgaggatgtggacagtccccggccctgcatgacaggtatagagaagcctgtcgaaatcgtcccggttgtttatggtgagtccattccaattgtctgcaaacagacaccctcaacctccgtcggtcactgcgactagcaatgtcgctcccccacgtcccgcttgtcggaggtttcagacacccttaacttccgtcggtcattgcgaccctcgttctccagttccttcaaaacacccctgagtttcagacacccttaacttccgtcggacattgcgacattccaccgcagccactgagggagagtgagacgatgtttcagacacccttaacttccgtcggacattgcgactcccgccgagctgcaaactgtgagcgagacgagaggtttcagacacccttaacttccgtcggacattgcgactgcctgttcccaagccattggacggctgaagtttgggcggcggtttccgcgaaccggctcgttttccagcgaccatatagttgaggtacaaacgtcggttgtcgaaagttattgcactcgaaacggttgcagctttcgcgaacatcccgcctttgagccatcagttgaggttcgcggtaaatggcgtcccgatcgacaacgctggccatcgactttggcgtgaagtacgtcggcattgcgctggtcgagcataacgagaacgttcataaccgcgttctgtacgcggcgacagtcgttgtcgatccgaagccgctgaggagcctggtcgaaaatcgggctgcaacccggcggcttcgtcgtacacgtaagacgcactcgcgccggttgcgacggttggcgcaggccctggctggggttccaaacgccgaggcgattgtccggttcagccgacggcgcggatacagccacgaagcccccgaagagcaggacgagcagacgttccatgtgccccgcgaacaatttttcgtggcactgaaagacgagatcgaccgccttgtgccggatcaagaccgggagcgcgttttggcaatctgcggcgaacatctgaatcggctccgtcgccgtggtgccgagttgcggcccgcccgattcgacaaccgcggtcgctcgcgctgcaactgggaggggtgccggcacaatgttccccgagcggggaatgatgtgaggggtcggctccagcaatcattattcctgtggcttcaaccggttttcgggcagactgctgatgtaccccgattccgcaaatcactgcaacactggatcgacgaactagctggtctggctaaagcgtatcggcagacggagggcgacgcgcccgagatcaaaggcgcgcgcaagctagtgaacgcccgcatcaagcgagttgccaagaatttacgcgaccgggttcacggcgaagcgcaaaatgatgttgtggagaagtttgacattgactggaaagagtattactggccgcagatcgctgaaatcgtgaggggagaatccggcgggcgagtgagattctgcggcgagcattcgaaaatgttcgtcgattacgtgatggcgggtaaacagatcccgaaccggcaggagatcaacgacggggatctgatttcgcggcagcaacggatcgtgtttcagcgactggcccggctggtcgaggggcggatacttccgctggccggcaaccagattgaccgcgtcgtcgtcgagcgcgttgcgttcgacgtgctgacaggtccgctgaaggcccgccagtcgatgtccgagtcgaaggcggcggaaatctattggtacgggccgcaggcgggcttcgagagtcgcgcccaaatgctggaagccgaattcgcgggaacctgtgcgtattgcggcgagaagaaatcgacaaccgaggttgagcacatcttcaaccgcagcgaattcccgttcgactcgtacttcaacgtcgtccccgcctgccgcgagtgcaactcgcgcaaggggggccggacggcgttgcaggccggcatgacgatccatgaagcagcatacactgcatattgcaattatctgcggtcgattcgagtcctgcacccgtaccacacggtcaaaaaggggatcctgaatttgttgcgccggtcggcaacgtctgaccgggcgcagcagatgatcgggctaatcgccgacaatctggtctcggttacaaacacgcagcggtcaccgcgcccgctggcccgctatctcacaacgaagctcgggcgactgatgggaaacgggccaaagattgaataccgtgcgggtcgtcatactgccctgtatcgcagcgtgatgcttcctgagtacgcgaaggcagaacgaaaggccgaaggggacctgcggaatcacgcgctcgatgccatcatcttgggctgcgagcttccgtcggcatcggcattggaaaaccgcaagtggacgaaaaccgcgggtgacgtggcgcaatggatggagagcgtcaaagcagcgtcgccggcgatgctggagggaatgccgcgcgtcgagccagtcgagttcgttcgattctttgagcaagacgcaggcggcgggtactgtaccatcgacctgagcgccttcaattggaaccgccggcggaaggccgcccataagctggacccgttcggcaaaactgccgcgggcgttccatacaaacgggactcggcggcgaacgtgttttcagagctggtgaagggcgcggcggcccgcgacaagcagatcgaagtgatcgcacaccgcggattacgccaagcgttggcgctcgaccgagaccgagcgggagagacattggtcgcgtggctccagcagacgacaaaggcagggctcgccaatgagaatatgtcggcacatccagccgatcgcgaacggttgcggctgctgcaaaagttcgtcgagacgccagttgtcgagttcttcaagaaagacgaaccggcagggattccgtgggtgatcggggttcgctgcctcaatcttgataccggtggaccgcgaaaggtcaacgtccggcgctcgatcaacgggaatccggcggcgcagttctaccagtctgaggcggtcattcgcgagatgtacgtcggataccgggccgagcatgggcagctcgaccgccgacacccgattctgttcgccgtcagccagatcggcgaactgagccgaatagcgcggggccgctgggttcaagttgatatcgcagccgacagtcctttgcggggccgaccactcggagcgactgacgacttgggacgattccgtgaacagtgggacgcagcgttcgccgacgtgcgccaagctgaaggcattacgaagctcttccggctgacacagggctgtgtcatcgaaaagatggatggcacgcaattccagatcaggaatttcgacaagagcgaaccgtggatgtcgagcgagtcgctgaaagacatacggcggattcatcggtcgccgttccgggtgatgggttaaaccacaatccgacgtggctcgccccggcaatcatgccggtccccccgttacctgatgcccccgcgactcgcgagaagctcactatgcgaaagaagaaaaccagatcgaccagcgccgatcgaatcattgcagcgatcgaaagcgcagcgggggaaatcgtgtcagcaaacgacgcccgggcgaccggcgtgcggcaggctgatgcggcaatttgcaatcaaggctcggcgacgatcggggaagcagccagcttcataggatgcagcaagagaacggtctgccgactgatggacgccggcaaactcggattcacccgcggcgggaaggttcggaaagttccgcggatcgaactgtcgcgatatttggaacgcggttttgtgcccgcgactgattcttgagcgtctatcatctcgcctggttttgtcgccagtccgacacgccgtcggccgggcttccgccgagcgatcaaggtcgccaagctcccgccgattcgctttcacgatttgcggcacacacgcaacgcgcgatcaccgtcaattggctattaggcgcagcacggtcgcaaacttctcgttaacaaagtgccaaactgcaatcgcttcatcatggccgaagaacaacttgcagatccagaaaacggaaccgaccaacattctgatccacgccgtgcgtccagtccgcttgatctcggtacgcaggacatcaaattcgtgacgcatgccagcagactcttcagcggacatggatttgatttccacaacgtgctgttctacctcatccaaacgtgccagcagcaacttttgctggtcctcagtaaacggaacgtcactttgcgatatcaaggccgcttcaagcggaggctctgccataaccgtgcgaataaagtcatcagcctccacttcacgggcaaggtacttcgtccatttctcaacttctagccagcggtcattccagtagttctgcgtgcagttgtgcctctgtttgtcttctccaggcgaatattccgtgacgtgcattccgttttgctggaaatcgaaaagaaaatagtagccagtcggcttatgtatgatcttcgacaccacctgcgtcgagttgccgacttgcaactcctcccactcaaaatcgcgcgggtcgagtcctactgcgcggcacgattccagaacctgcttcttctgactggcaagcaagacacgcgaatcggcggccacaacccctcgcggctgcggtttctttctgttgcgcttggggcgcgtggttcctgcttgctgcttcggtggacgtgccgcgccatccgaggcggctcctgcagccgcgacctggccgccgactggctcagcggctttgatcgccgacgatggtttttcggcttgattgacaacgaaatcggccgtcgtgcgcgacccgagacgaatagtcgtcttttcggggagccagacccagcgctcgacgggaagtatggtgtcgtccaccgcgaccccatcggggaccgaagtaaatatggcaaagcgtccttgccggtgaacgatgctggcatggtagttgccgagctggggatccgaaagaacaacctcgttgtcgggcgcagttcccaggcgcgccatctcgccggccagctcgaagaccttgccccgattagggccggccgtgacggtaatcgttgcgctgacggacattctcggaaatttacgccggtctcagggatggggcgtcgcggcccggctgaccggggccagattagtgtctggatatctgcgttgccgaatgcccccggtgggagtcgaacccacacgcctttcggcagcggattaaccagagcacgcatccgagtgcgctggttcaatccgctgcgtttgccatttcgccacgggggcttcggttcaattatacgccgtcagtcgggttttgtcctgccgtcccgcgatacaacatggtcggctcaatttccgacaaaacgcgcgtcaagcaaccgcgagttagaaccgactccgagttttgacgtttgcgggcacggactggatcacgccaaatcacgatcggattattgcaaatgccaccgaaaccggactttcgcaaaccgcaacagaccaggtatcgcgatacccgcgaagatcagggaacatttagagcgacggttcctggaaatgtcgctctatcgcatttcaaggataatgcccgcgactacaaccatttctacaaccgaaagaccgcgctaaccccaattattccgcattttcggatgcatttcggccagccctgaaaagtgcgattcaccctatatttccggggatttcatgcacatttcgcgacgctgcccgtcgctttaggaaaccgtcgctctatcccctgagctacgggggccgaagggctgggatgctctgccagccaacggatcggcgaacatgcgtgaatcgccggcgcgcgacaaagcgctgctgaggtgcgtcgagcaaaaggaggcgacgtcaatctttggccttcgtcgccttcggtttcttgtgccccttttcgaaatcggcgcgcagaatgaacttgattgactgattgttgaggcagtacttctgcgcgaccggctggccgcctcccgcaggaggggtgccggcgggctgaccgccgccagccggcggaacgaagcctgccggagggacaaagcctgccggaggaacaaacccggcggggggcacgaaacctgcctggcccgcgggtggctggccgccggcagcgggagccgcgccggggggcgccgcgcccggtggcccgccgccgttggcaatcaattgccccaggttcgcgtcgcagcgggtgcattcgatccgcttcttgtcgttcgcaatcgcgatggccttctcgtcgagcacctcgttgaagcacggatagccgttcttcgcatcgtacttcgccgtcgaatcgaagagcggctgaccgcagcaggcgcaaacgtaaacgccgtccttcgaattcttccataggttccccgtgaacccgcgttcggtcccctttttgcgggtgatgcgaaactgctcgcgggaaaggatcttcatccactccccatcggacttgacgattttcttcggagcgccgtcatcggcgtccgaggtcttgtcggtgaccgaagcgtcgtcggtctggcccgctgccgcgccgtcgcccgttttctttttcgaacccgtgcttttcggcggggcggcgaacaccgcgccgaagacgaccagagccagtcccgtcgagagcgccgtcacaattcggtttcgcagcatcatcagcacctcggcgagccacgcgggtttcctgatgccctatcatcgccggttcagggtttggcgtcaaagtcaatcgggccccaggttctgaggatgtgaaaaaatcgaaccagggggacagtgtgtgaaaacccgctttcgggttttcacacacacttcgcgtgcatcttattgtaacgcttttggagctttggcgttgtgcaatgcaaaggaactacgaagggcgggctaatcaaaatgcggcatcgccgcattttaattaggaagtccccctggttcgattttttcacagcctctctgccgaattctcattttgttcggttcctagataacgaaaccgtcaggaagaaacgcaacgcaggcttgtctcattgtcgtcggcgggtgcatccgttaagcaggggtgccagcacggttcgaatcgggatgatcgcgaccttgtagagcctccgactggacactccgatggatattggcaactccgtggaacgctgctgcgaccccgctggggtcgaatcgaaactcgccacacctgatccgggggtatcgctttgctcaacccccggctaatggctgcgacccctctcggggtcgaattgcgactacgtcgcgaaagtaaggggggagggagaagaatgcgccgaacgtgcgccatgtcagcggtgcacccccggacaacggatacacccgtcgtcggctgccagggctgcgatagacgtgggcggtggatgatgtagtggtcacttccgaagatgtgttacagtggcggcatgaaccagaaccacaaagtgtgcgatatggacatggccctgaggcgcatggggaggaatgccgagctcctcagggaagtcattgaaatggtgcgtgccgatctgcctgagattctgaaccgactgcgcgcggcgttagcggccggggattccacgctggtgcagcgcgaggcccacagcctgaagggggccctggtcacgttcgatgcccaggccgccctctctgccacgcagcgcctggaacagtttgcgaatgcgggtgatctgtcgcaggcggccgcaatgatcgagggcgtcgcgcgtgaagtggccctgctcgacgccgcgctggcggccgagttgataaaggcgccgccagtaacgtaacccctgtctgggattcactcagactcgaagcaattgtatgctgaaacgtcgttcttcatcgaaatattgtgtcaatgaatgccaatgcggcggttcttgttctgggagcgggagtcagtgggctcacctgcgcgctgaatctgaaggaacgcggattcgacgtgaccgttgtcgcggaagattttgccccgcgcgtcacatccgtcgttgcgggagctttgtgggaatggccgccggcggtctgcggcactcatcaggacgaggacgcattggcccgatccaagaagtggtgccagatttcctatcgccagttcgcagctctggcccgcgagtcgaacacgggcgtgttcatgcggacggcgacccattacttcaggcagccggtcgtcgagagcgatgagcgcttgaggaagatgaacgagctccggcagcacgtcgatcaattcgtgcacgagccgtcgctgatttcaaccaatcaggtgaatcctgagttcggaatacgcgacgcgtattcgcatctggcgccgatgatcgacaccgatgtctacatggcctggctgctggagagggtgaaacaggccggctgccgcgtcgaatgccagcggatttccggcagtttgcgagagcaggagtcgtccttgagggagcagttctcggtagacgccgtcgtcaattgtgcggggatgggcgcccgggaacttgccgaagatgccatgtttcccgtgcggggagcgctgattcgcatgcgcaacgacggcaaggcgatgccgcggatcacagaggctcactgcgtctcgcacgacgaaaccagcaccgagccgaactttattttcatcgtgccccgcggaaatgaccggctcgttctcggcggattggtcgaacccgatgaatgggatctgaatatcggtttcgacaatcatgaaccgatccgccggatgtaccagcgctgcaccgaattcatgcccgttctgaaaagcggagagattgaaaaagccgaaccggtgcgcgtcggcctgcgcccctttcgccggcagcacgtccgcgtggaacacgagccaggtacgcgcatcgtccacaattacggccacggcggatccggtgtgaccttgtcatggggatgcgctctcgacgtcgccgacgcagtggaccgcgtcttgtccgtcgcccggtaacggatgaaacggacgaaacgaaacactaatcggcactaatcaacactaatcgaagcgtcggctcgcgctgctgtttttctaaccgccccgacggaatcatcgtcggtctacgtgacaatctaacaggtcatggaaggagatcgctgacccgacaggtgaaccccggcagaacatcttcgccggtcgccgtcgccgattcgtgcagaacgcgcccttcgtcaggcgtacggtaaatcgtcaacgtgcggtcttcgggcgcaattacccacaccaggcggacccctttggcaaagtactccttcagcttctcccgaatttgctgggacgtattgctgggggagaggacctcgaccagcaaatccggcgcggcttcgatataccccaccggtacttccctcaggcgctccttcgaccagtacgaaatatccggcccacggacgctgtcggggttgcgctcggtgatgaatccggtgtcgttgcacgccaccgtgccaatgccggcggcatcgacgaaagcgccaagtcggcggtcaactttggagcaggtcacgccgtgcaatcccccgggcggaggcataatgacgatctctcctcggacaagttcctgttgggaaccatccttcaggtcgggaatgaggaagaattcctcggcagtcagtagcttcgcatgggtggtcgtggacataacatctcctgcaaggtcaatcttagccggcgcccggttcgcactcaagaccggcaattccctgcctggatgcgagtcaacgtactctgggattcctttcgacgagacgagggcacacgggactaacctatcggtcggtgcccgccgctgaatttgacgaaaagacggcacacggagtgatgcctgctactctcgaggcgacttcgccgaggtggggcgcgcctgccaagcggaagtcgcatgaaatctgcgcggggatggtgccatccattaatcgtccgtgccctgcgcaggctgggcaaactcaaggttcgcagggccacgatcgtgctggttcgaagtccgcccggcaatcgcccacttctgtcagcttgccggccaggaacggctggcgcttcccccgcttgcagcgctcgacatgaccaatccgcgccgatacgctgattttgtaactttgaaacgtttgtcccggccgtggcatcctctttttgcgaattcagccgatgacatctccggcggtcgagaactttctggccaacctcgaaaaaagcaacttgctcgcagccgatgcgctgcaaaaggtgcgggcagacgccgaaggcagcggtgcaaattctggactggtcgaattcgcgctgaagctggtcgaacaggagctgcttacgccctggcaagtcgaagcgctcgtcgccggtcggaccagcttcttcctggggaaatacaagttgctcggcgagctcggccgcggcggcatgggggccgtgtacaaggcggtgcaaacgcgattggggcgcgtcgtggccctcaaggtcatggccacgaaactcgtgagtgacgagcaggccgtctcccggtttcgccgcgagatcgaggctgtcgcggcgctcgatcaccccaatgtcgttgccgcctttgacgccgaccagaccgaggggactcattttctggtcatggaatatgtcgaaggagaaagtctggcagccttgctcaaacgcgaacatcggcttccgatagcgaccgcctgcgattacatccggcaggccgcgctgggcctggcccacgcccacgaacggggaatggcgcatcgcgacatcaagccggccaatctcctgctcacgcgcacgtccgacggccaaccgctcgtgaagatcctcgacatggggctggcgcgctttaccgtcgagcgcggcgaagaaaccgagctgacttccaccggtcaggtgatggggactcccgactacatcgcgcccgagcaggcgcggagcacaaaaagggccgacattcgcagcgacatttacagcctgggctgcacgctcttccgttgcctgacaggacatcttccgttcgacggcgagagcgtcatggagaagttgatggcgcgggcgatgggggatgcgccgccgctgcggcagcgtttgcccgaggccccggcggcgctcgaagccgttgtggcgaaaatgctggcccgcgatccggcggcgcgatatcagacccctgccgacgtcgccgccgcgctcgaaccgttttcgacaatgaacctggcccgcgcgtccctcgcgagaacggcggttcctgctgccgcacgagatcccggcgtcgaccggctcctgcagcaactcgcgcgggagaccgacgtcgatgagtcgggggaaaccgacacgggcggcgggacacagttgccgatggctgcgggtcctcggcgaactggcgggaagctcttcgccagcgtcgaagaacgcaggcgggccgatcggcgacggataagacaatctctcttcggaacactgctgctcggcgtggccggcacggcagcctggtggtggtgggcggctggccagacgcatctcgaattcgactggcctgccgaggagcgtgctggggcacacgtggaagtcgatggttatcaattggctctccccgaacgggccgaaatccgcgttccacccgggcgggccggacgccgccgtctgcacatcgtccgccccgggtacgaaacgatcgacacgacgcttgagttcgcgcgtggccagaagcagacgtatcgacccgagtggacgccgactgccgagactgtccgtttgcagcagcttgcgggcctggattccgagatcgattccctgttgaaacaattcgccggtcacctgccgccggcggacaactcggccctgcaatcgctgcggcaacgcttcaccgagctgcggcccgcatttcggtccacgagcgaccagccacgattcgacacgctgtggcgccggctcccctttcctgccgactatttgaatctggatccctcactcgaccgcaacctggcgctcgaaccgctggtgatgtcgccaccgccgatggaactggtggcggcgtggggagatgctcgcttgaaagtaccagccccgcggtcgctttccgtctcgcccattggccgcctggcggcgacctggtctaacaacaatacggtgtacgtctgggacctcgataacggcaaattgtatgctcctccgatcgctcccttcgaatgtcaaggacctgcctatttcagcccggacggtaaattcctggcattcctgacggacgccatcgtgatctggtcggtcgaggaacggcgagccgtgaagacgattccccttccaggcaccgccaacgcctacacctgggttcccggcagctcgctgatggcgtggaccaatgaaaatcatgccattcatttgtcgaatttcgagaccggggaaatgctggaggatcttccctttccatcggacaacccgcaacacatcctcagcctggcggccagccgcgacgggaggtttctggccgcgctcggggctgctggaaaactccgtgtctttgagctcgccacgcggcagtggtctgatctgcctatggtcggagtgaccccgtatgtgctggccttcagtcccgatggcggccaacttgctgccggcattgacaatttgatctacgtctgggatctggcgacacacgaattacgtttcaagacggaacccggcgacaactggggaatcggtgttctgagctggcgacccgacggaaaacttttgtgctcgaacactggcacggctgaggtcctgttgcggaacaccgaaaatggagaattgcagacgcgcctctcaacccgaggatatgcccacacgcaggccgcgttcagccaggacggccggcggctcgtgaccgcctgctccgacgggccgcttcaagtctgggacgccgattcgtaccaggaagtccttcccaccgggcctttcgttgtttccgccgcgatcgatccgctcggcgaatggatcgcattaggcacgagcgaccggacgatcgagctgcgcgacctggcgagcggcgccattcgcgagacgatcgcgctgcgattcgtgccttcccggcttaaggtgagtcccgaccgaaagctgatcggggttgtcgccgcaccacccgactttcgtatgtatgcgatcccgctcgacgggcggcagcaggttttggaattgcgggagctgggtgcggcactcgacgtcgctttttcacgagattccgcgctgctcctggctctcgaccagggaggacacaatatctcgggctggaacctcgccgattctaagctgaccttcaaagccgcgttagacaatcccaaagtgcccgctttaggcttgcagatggccgtgagcggcgacggccgcacgttgttcgtcgtcggaggaaccaaccacttcggctcgattgccgctttcagcctgccggacg

SEQ ID NO: 110 - DNA, 4689 bp, synthetic construct
  misc_feature 1..4689: note = Synthetic
  source 1..4689: mol_type = other DNA
ctcggcttcgatcgtcccgtatttctgaaatgggaaggtatccagctttaactcggctttctgacccaggtggatgaaaccaatgtcttgattaagtgccatggcttctacaatcaaaggagtcccatccggaacaatggtgataatgggttgtggtgtgcagggttcaaatccctgtaccgccaccaatcacacttaattatttaaatagcttacagatttcaaacccttaaaaagaccgtcaccagactgtcaccgcaactgaattaagagcctttcctaattctcattgacacccttttcgtaatttaatacactctaatcgatactgaagctatccataattaacctctaacccggtgggtaagtatgcaatccagggttacactatccattgattttggttataagaatatcggggtagccttggtcagggaccaagatggaatcaataccccgctgttcgctgggactctcctctacgacccctttcaactcagcacaaaggttggaccgagggcggaactccgcagaggccgccgaaccagaaaaacaaagaaacaccgtctaaatcttttaaaaaagaaattgttcgatacaaatctcccagaaggagcggttcaggaacttattactttttgtaggcggaggggttatagctctctgtttgatgtaaaagaaccccctaaaactggaaaggttgactcaaaagaagaaatcgtttttcgttttagcagggaagagttttttgaagcattggaaaagcagatagatagattggtacctgacgataaaaaggaaaaggctcttactttatgcgaagccatacttaaccgagccggtgaaccttctagagaaatccgaccattaagaattaataatcgaggagcctcccggtgtgcctgggacggttgtgagaatgtgacaccacgccgggataatgctctccgggaccccctgtcccaattcgttcatacggtatttgccgcaagtctcagaggcgatgcaaccctccaggatgaagtcgcaagaatgttggaccgtatcgccgaattagggaagaggcttcgccatcgtggaggcactaatccagataaagagcgtaaggctctcaaggcagaaatcagcgaagaacttaaattgttaaaaaagctgtatggcctcagtcctgatttgactgaagaggcggctactccctgggcgaaaattcggcagaatataacgaacctgatagaacagaccggagggcgaaatcggttctgccgttaccacagttctcaatatgtgacccacttcatggaaggtaaaccgttacccttcaaggcaactttgaccgaaagggatttggtgtctcgccgggaagaaatccttttccaaaagatgtggcgttatatcgaggcgagaattcttactcttgtccccgatggcattgaccgtgtgattgtagagcgaaccgccatcgaccttctggggggaagccgaaaacagcgtcaaggcattataaataaagaagcccttgaggaaatgtatcagcatgggcctcgatacggattcagcgatgaccttgaaatgctgagggctgaattcgatggtctgtgtgtgtattgtggcaggccaaatgccgaattggttgaaagagaccatcttctgcctcagtccaaatttttcttcgacagctacctaaatatagttcctgcctgcccaccttgcaatcgaaccttaaaacaagccgcctctccaggaggggcttcactcaggattcacgaacaggcatacgatgcctattctaagtttatggcttccaagtttacgaataaacctccccatttgtttcataccatcaagaagggcgtcctcaatctcatgcgcgagcctggtcgcgtctgggaggcggagcagtatctcaacctcatcgccaaccagtttgcccaggtggttgggacccaacgaggacctcgccctcttgcccgttacctcagcgggaagatttataaacggtttggggagaagccccaaattggctttatcaatggaagacacaccgctctctggcggaaagctgcttaccctgaattcgataagtttagggagaaaaaagagggtggtgttatcaaccacgccttggatgcactcctgatggcttgcgacttgccggacctgacttctcttgaagcgaggaacttacagcccggtttgatgtattggtgggttgacaaggtgagaaaggctgccccacccaaaggcccagatggaatccctgtgatacccgaaccacgctttgccgtggctggttttgaaaaggttcaccctggaaactatattgaagctgaattggcaaagatgaactggaatcataaagacactaaggtccaacgccaaggtgcctatggctggtcaaaaaaagaagacctacctgtccagcgtgttacggctgcgggtctcgctgacgaacttcgtaaggccaacaaaaaaacatctccagaattgaggagggcagaggtcgataaaatcgtaaacgtgattgtccacccgcaacttcaccaaaccctgaagatggcaaatattggagacactccaggtttaagcacggcagaagcacttgcactctggttgcgaaaaacaattcggggtaacctaagtaaagcaaggttttcctctcatcccgcagaccaatcaagagctaaaatgcttcaggatttcatcaacgggcagtctaatgtaatccctgcagtcattgcggtccaaatactctatccttcgtttaaatccaatatggatttaaatcgagttgacccccaaagcggtcgccttgtacatagatatgtcgctgacccggcaaatgtggcttacatagtaacctatcgaggaagtaatggtgatgtcaaacgagacagaccgctaacgcttaaatggcgccagagcggagccgtaatccctggtgtcaaattgtttggagatgttccggaagggccattaagaggccgcgcattgggtgaaaaaacgattgaccagaaagaatggaagagtgccttgcatcaatacctgatcagggcagggatagctgaatataactttgtgtctcagggaaatgtagtggtttatgaagatgggagcgaattgtatatcaggaacttttctggtagctatggttttaaaaagtcctggttcaaaggaataaaagcggttcgaccttcgccgctgaccgagcgattgattccaaacgcaaaactttagaaagtttcggtttagttctttgacaactggatagcgtgttcgggttcaaactgaaaagagcatctgttcggaaggaccactccgggttagggcagacccggctcttgggcttccttggtcttttgactctggaggaaaccttccggcgtgtcgcaagacaagatgtgagcctattttaaaatttatttatcttgaattattttattagtcaccctgaacatctcaaccttgttgagacattattattttggtttggcatggtttaagcattatgtttcagtcaccctgaacatctcaaccttgttgagaccagcccttgccgcagaagaaatcttcttattagcgtttcagtcaccctgaacatctcaaccttgttgagacgctctggcatctgtcctcttttaatagattatatgtttcagtcaccctgaacatctcaaccttgttgagactctgggcctttcatctgtttttgctccttggtaagtttcagtcaccctgaacatctcaaccttgttgagactgctatccaaaattcataagtatttaggcgaagatggaggggtgtttccgcgaaccctattttaaacatcttaaagtttgttgcgtttatttgttaacataggtttaataagttgatttacttctaaattttagaatcgcgaacctcccagcttttgttgattactaatacttcatgcttaaatctatctcctttgtaagaaaacttttcatttattattatccttgagacatagttatcatattcaagaataagaaattggcttcactctatataaagaactggcaggagcatgagaaacattctgaagtatatggtgggaggagggcgataggtgtgagccccttggctatcatcaaatattgacaaatgggagttattaaaaatttacatggaggcaaagggaatgggaggggattgtcaaaatagcaaattcagaaagtggtggaagaaaatttggaagtataagacggtaatccttgctttcgcatgggtaatttcttttctactggggacaggtgcagtatggcaatggtttaatttgcaatttgaaaaacaaaggaatgaacttgatataatcagagtatctatagaacttcgtgacaatatagaaagtaaattaattaaactttttgatattggtattgaatatttaaaagaagaagacatccccaaaaaatcaagactaaagatacaatttgatttagagcttatccgtaaataaatattacttgtcgaaaagcgatcaaggcacatgctaattccaataatccctcgtaacttgcagccagtttttcaaaccggaccattaattttcgataccgattcaaccacgaatgtgctcgctcgaccacccatctgcgagcacgatatcgagggttctttctcttggctttcacttcctcgccccgttgtcgcacgtgcggaatgta

SEQ ID NO: 111 - DNA, 3332 bp, synthetic construct
  misc_feature 1..3332: note = Synthetic
  source 1..3332: mol_type = other DNA
aaagacttcccggccgctggcccggctcaaggtatgggaataaatcaggggggtgtggaggattaccccggtcaggcgtgctttggcttcctcaatctctttcagggtcatggcacgaaagataaaggcggcctcccccagggagaccgccccgggtggcgttagcgcgcaaatttaacggaatccaagaccccttgcagttcggaccgggccgcgtcgaactggtcggggtgggagaccacgccgaagttataatagtagttgtccttgtcataacattgccagatgatgcgctgatgggaacctccgcctcccttgcgggattccacgatctcccagccgatgatcttccctcccgcgtcatcccggcgcttggcggtaagaagtttgccgatgcccacctcttccttggcggtttttaaggaagcgtccaccgaggacttggccggaaagctgggcaccatctgggtataatggatatggaagaacatggtggttcctggcttcccgaaaccttcgcccgcggagttgggttttccttccgtccttttgtaacccgcggggatggtaaaggaaaagttccgctccgtattcttataagtcacgggggccgtggatacgggaccggttttggggtcatccgcaaaattaaggggggcgtctttatcatctttagccggtgccgccggtgccgcggattccgccggtttcttctccgcttctttggcccggcgggctgcatccacgccgctttggaccgcgccccattgagccgacaccagggacgccatcaagagcacggagagacccaaaaatcctaagatccccaaggtccacactgttttcctcattttttcctcctttagctggaaggttataaagatgcgagcctcaagcgtgctgcgccttgcgccagcccgcggccttaagcgccgccacatgttccaaccattcgttcttcaaggacttcagataaagggccagatcctgctcgatgaggggcgccaggcgccggtgcagccgggtattcacctcgtggtcccccggggagaggcccagccaggtcaggtaaccttcgtcaaaaataaatgccggggtggcccggtgcttcaccccccggatttccagcaagacctgggcccgagccacgtcatactccaggacccagccgcagtcctccagcatggtggcctcctcccactccacccggctgcgacattcaggacagtaaagattaaccaggatctccggaaagaggaggttgtcccggaagatgaggaaagcggaactgcggccacagaggcagaagcggcgttggttcatgcacatggcgaaatttcccagagcctctttaaagtcttgcctactaaattccaaattactagttttccactataatgacaatagacttaattgccgcctgcataaaagaatgaggtggggaaaagtttaaagacggaaattataatcgattgggattcccccaaggccccagcccctaccttcgcaaacctgaattttcactaagacccccgatccatgagaggcccaaggctgcgtttttatttgttctcctgggcctttgatgctatgttgggcatagtcaaactttttcgggtactcaccatgaggtgcccatgagctccacccacaccctcgccattgacttcgggtccaagaacatcggcatagccctggtccgtaatcaggacagcctcaacaccccactcttcgctggtaccgccctctatgaccgcttcaccctgagcaagaaggtagagccccgcgtccaaatgcggcgcatgcggcgaacaaagaagaccaggaaggccagattggcccacctggaagcaggtttgctttcccatggtctggagcccgacgtcgtggtatggctggtcaatttctgtcggcggcgggggttcaagtcattattcgatgagggtagagagcccagaggggaaaaaaaggaagaggaggccgaggtcttccgcttctcccgcgaagagtttttcagcgcccttgaaaatgagttattggagcgcttgcctgaggaaaagttaatcccggtattggacctctgtgagcatggcctgaaccgggatggggaccgcttcaaggaggtacgcctcatcaggatcgacaaccgtggcgcgtcccgatgtgcctgggatggctgcaacagcgtcaccccgcggagagacaatgccttgagggatgccctggcccaattcgtcttcacggtctatgcccagaaagtccgcagtgatccagacctctatgagaaaatccagcgcatgcttgatcaactggcacaactgggcaagcgcttacgtcatgtgggaggctcagacccgaagaaagaacgccaagttctactcaaaagaattagagaggagctgaagcttctcaaattcctatccggactggcccaggatttgcccgaagaaaccatagagccgaaggaggcctggacccatatccggcgcaatctgatgaacctgattgagcagagtggaggccggaaccgcttttgccgccaccacagcgcccagtatgtctatcacctgatcgaaggcaagcccattccttttaagcgatccctcactgaaagcgacatgacctcccgccgggaggaaatcttgtttcagaagctgtggcgctatattgaggccagagtccttcccctggccccggcgggcattgatcgggtggtggtggaacggacagccttcgatatgctcgcaggcagcaggaagcagcgccagaaagtagcggatgactatctggaagagatgtaccagcagggccccaggtatggcttcaaggacgatctggagatgctgcggaaggagttcaacgggctgtgcgcctactgtggcaagcccagcgaaaccatagtcgagcgggaacacatccttcccaaggccaacttcttcttcgacagctacctcaacatggtcccggcctgtccggactgcaatcgcatgtggaaggccaaggcttcccccggcgcttcaggtctcaggatcaatgagtcggcctatcaggcctattccgactatcttgccgacaagttcaagaccaggcccccccacctcttccacaccatcaagaagggtatcctgaagctgatgacccagaaggatcgggtcctggaagcagagcgtctgctgggaatgattgcggaaaacctggggagggttgtggagtcgcaacgaggccccaggcccctggcaagatacctttgcgagaagctgcgacagaggtatgacagggttacgcagatagccttccgtagcggtcgccacactgctatctggcgtcaggct

SEQ ID NO: 112 - DNA, 4157 bp, synthetic construct
  misc_feature 1..4157: note = Synthetic
  source 1..4157: mol_type = other DNA
ggttaaagatattgacgaggcgatcagctttgccaacaggacacccttcggattgggggcgagcgtgtggacgaagaataattcagagatagaaaaactcattcaggagattgaatctggcgcagtttttgtcaacgggatggttaaatcagacccccggctgccttttgggggcatcaagcactctggatatggaagagaactgggtatctacgggattcatgaatttgtgaatataaagacggtgtgggtgaaatagcaaaaaagcaatatacttgcaactggtttaggtttaatataaattaaaaaataatgacttaaattcaaataagcagatagggtatgttagcgaaacttaaaaaatattttagcgaaagaaaagatattgcatttgcttttttgtatggttctcaggcaaaaggaaacgctacaaaattatctgacgtggatattgctgtatacttttatccccggcaaaagcatcccgtggaatatgagtcaaaggttttttatgataatgaagataagatatggggagacctcgaacggattctaaaaaaggaggtggaactccttgtgctgaaccgggtttctgccagtgtagctgcaagtgcgattagggcgattcctcttgcgatcaatgattgggggatttatctcgattttatggaggttataacagatgaggctgaagattttatggaattagttatcaatgattataaagagaggataggatttgaaacgagaggctaaagtaaggcttattaaacatataacctttcttgaaaacgaacttctggattatgaacgattcaggtcattgtcatgggaagaatacgataaggaaagggataagagaagaaatgttgagagatggattgaaaatattgtgaattcgtcaatagatattgccaagataatcttagcctcagaagacagatcactccctgatacatacaaagaagttgtatctaacctttcacttgttactggtttcgagagtgaaactatggaaagtcttgctgaacgggttaaattgggaaacattatttcccatgaatatctggatataagatggaattctataaaaagatttactcaggaagcagagccgctgtataaaaacttcgtagtaatggttaaagagtatatcaaagaaaatatttaactgtcggggcggatatgcaggttcaaggtgcattgcccggagattataaagccgtctttgtattacaagcaaaggcggttattttgttttaggggggataatgagagctaaaacaccatgtgaaaacgaccccaattccctttctgtataagagatgattacccttggcattgattacggcgcctcatatatcggcgttgccctcgtggaaaacaccgggaccggcaacaggcctctcttcgccggcaccatcgccataaatgcccgcgatttgaaagatatggttgaaacacgggcaggcatcaggcgcctcaggcgaacgagaaagacaaaaatcagacgcctaatgaggctcagggaaagccttcttgcctgcggcataggcacggaccaggtcaccctcatcgtccgcttctgcaggaaaagaggttataaatctctttttgatgagggcgaaagcgaaacccgcgaaaaagagagcgacctcgcttaccggttttcccgtgaaaccttttttgaaagcctcgaaagggaactcggcctcatccttccggacaaccatctgaaacctcaagccctgtcagtctgtgagagggtcctcaaccggaagggagaccctttccaggaaatccgccttatcaggatagacaaccgtggagccagccggtgcgcctgggagggctgcagcagggttaccccgaggcgcgagaacgccctcactgatcccatcgcccagcaggtctataccacatgccaggaaaagataagagaaggtggagagcaggcaagggaaaaggttgacgatacggtcagtcagcttgccaccctcggcaagcgcatcaggaacgcctctggagaaggggcaaacaaagagaaaaaagtcctcaggaagaaagcgcgtatgctcctccgggagataaaggaactctattaccagccagccagggagaccctggatggtgagaaggcgtggaagtatattgagaccggcgtcctgaacatcatggagaagtcacaggggagaaaccgttactgtagagagcacagcgccgcctacgttaaaacagtcctcgcaaacgaggcaatccctttcaagcagaccatatcagagtcagacatcatctcgcggagagagcagattacctatcagaagctctggcgctatatagaggcacgggtgcttcccctcgccccctgcggcattgaccgcatcgtcgtcgagcgcaccgctatcgacctgcttgccggcagccgcaaaaagattctggatgcctcagaccaaaccaaagaggagatgtatcagcatggacccatgcacagattcgaaagcgtctcagaaatgctgcggaaagagttcaatgggctgtgtgcctactgcgggaagcaatcggattctctcatggagactgagcacatcctgccccgggcagagttcttcttcgatagctacctgaacatcgtgcctgcctgtccccggtgcaaccagagtaagggagcgcgcaccccctcggctgcttccctgaaaatcaacggcgaggcatacgaggcatatacgagctatctccagagcaattttcgcacgcgtcccctccaccttttccataccatcaagaagggcgtcctgaacctgatgcgcgaccctgaaaggcagtgggaggcggagcgttacctctccctcatcgccagccagttcgcccaggtcgttcagagccagcgcggaccacggcccttcgcacgctatctcttttcacgactgtcattacgtcaggtcagaaagcctgaaatcgtattcaaaagcggacggcacacagcgctctaccggaatatcgcctaccccgacttcagcaagtatgcagaaagggaagaagggggtgtagttaaccatgcagtagatgccatcctgcttgcgtccgacctgccagacccgaagcctctggaagcgctcggcttctctcccgctgatatgcgcaggttctgccgtgccgtcaggcagaaggccccggttgcaggtgatagcggcgtgcctgagcctcccgcccgcgacttctttgtagagggctttgaatctgttaaatccggctttgtagaagtgaggcttgatgccatgtgctggaacaagcgtgacagcatgacccacaagcaagacccctatggcctttctgagaaagtaaatcttcccaccaagcgggtgagcgcttttggcctctgcagcgaactggaaaagatgaaagatgaaaaaggagtgaaaaagaaagttgacctcattcatcaccctgccctgagaaggactttaggagacgccatcaacccggaaaaccccggcaaatcagcggcggaagcgctcagggcgtggctgagcgaatcggtgagaaagagcatccagacgtctgccttctccaacaaccccggagaccagcaacgcaaaaaggagcttgagcagttttcttcctctgatgagtcccttatcccggcggtaatcggcgtcaagatgttcgatatgggggtgagggggaagattgacctccagaggatagacccgcagaccggcaaaaccgggcaccgctacatgacccagcctgcaaaccgggcagtcatcctggcgtatccgaaaaagaaaacaggcatgacggatatgtccaagccctgcattgcccgggtgaggcagaactattcccttcttcctgagggaaaaggaatcttcaaggaacttccggagagattgaaggagggcataatactcggaaaagagaataccatcctggacggctggaacagtgaggttgagcattacctctcagtctgcggtttcagcagttatggcatgctcacggcgggatgcgttgtctgctacggagacggcaagaagtggtttctaaaaaatttcgatgaaagcaaggaattcagaaaggcgagactaaggaacgtcgttggtatcctgaggtcgcccttctccggaagaatgacgccattaaagcctttgactgag

SEQ ID NO: 113 - DNA, 13491 bp, synthetic construct
  misc_feature 1..13491: note = Synthetic
  source 1..13491: mol_type = other DNA
catcgtactctatgtgaagcaccttctgtttcggaaaccggggccgatgctcacttctcagcatctacggccctgtcgccggttggcgccgtccttgcggcgagaccgcgtcagggcgaatcgacatcgacgattcgatcacaaccccaaatggaggttaccatgaaagttgttgccatagattccagcccgagagccgacggcgtcagcaagaccaggatgttgttggacgctctgctgaaggggatgcgcgaagccggcgcggaggtggaggcgattcatttgcgtcagaagaaagtcaagaactgcatgggctgctacacatgctggaccaaaactccgggtgtctgcaccatcaaggacgacatgaccaacgagttattccccaagtggctcgcggccgacctggccatctacgccactcctttgtaccactttaccgttaatgccaccatgaaagcgttcatcgaaaggacgttgccggttgcagagccttttatgcaacaaggggacggcaggacaactcacccgctgcgccacaaagctccggaagccgtggtcttatccgtggcggggttcccggaaccctctgtcttttcgcagctctcctcatacgtcaatttcctcttcggcaagaggctcaaggccgagatctaccggccggctgcagaactgatgccccttcccgaaatggccgagacaacgaaagagattcttgaagccgcggagcagggtggccgggaactggttcaatccatggaaatttctcgcgttactatggaacgtatcacccagcccattggaggtggctctgactctgtcgccaaattggcaaacgtgttttggaagtcttgcattgctgaaggcgtgacaccagcggagttcgaacagaggaatctcgtgccacgtcccgattccatagacaccttcatgctgatcatgtcgaggggcttaaatcccgaaggctctgccaacacccgcgcaatcgttcagttcaaattttccggtgaagtcgaagggtgtagctttttccggatagagaacggaaccattgaggccagggaagggctggcagacaagccggatttgaccattgagtcgcctttcgacgtgtggatggacatcacgaccggcaaggccgacgggcagcagctgttcatgcagcagaagtacaaggccactggcgacttctcgctgctactgcgcatgaaagatctgttcggcaaacgggcaggatgagtccgaccgcaaagaagagccacaatggtcaagatcgcggcgtaaccaggtcgctttcaaagaagtaatctggggagaagcttctttgcacacagaagttcttcgcgatcttactcttttgaacgcgcatcggcatgacgcgtgtggaccgcgattcaccctgcctggaattcctccgcattcgggcagtcttccacggaaggttgcgggacccttgtttgcacaagtcgacgccggtgaatatcgtcaatgaaagagatgattggtaagcgccgccggtggctggaagcggccggacataattgatcggaagattagaggatagtcgtcagatgaagcgaatttactacctccttactggagtactcggcctgaccttcatattcgctgccggtctcgtcatcgtggaagcagccggaggaccgacaatggaccggttccactcattctggatcgatctgcacagagccagctcggtggggtttgcactgttctgcacgttcttgactgcggtatggggagttattctcgggctaattacggatcagatcatgaaattgactggaatcgatctgaaatcgagagagattgttgaattgtgattgtttgagagaacgaggcctagtcgaccatggagtggctgttcatgcatatgcccatggccggggtaaatgtgttctggcccggattgctcctcatcgggttctcggtgggagttatcggcggctttttcggaatgggcggagcttggatggtgacgccgggcttgaacatattgggctttcccatggcgtacgccataggaaccgatgtagcacatatggccggcaaatcgatagtgtccactcaccggcatgctcagttcgggaacgtcgatttcaaacttggcgtgaccatgattgtggggaccgttgggggaatagaatgtggagcacggatggtcatgtggctggagcatctcggttgggtggaggccgtggtccgctgggcgtacgtcggcgtgctcgcgtcggtagcgctcttgatcttcgctgattacaggcaagccgtcaagaatcaagaggccggcattgtagaagaacgcggggcggtgggtttcacttggtacaagactctgcacgagatcaagatcccacctatgatgcatttccctgtcgcagacgtatactgttctgtatggctccccattttcgtgaccttcgttaccggcgtcatggccggtttcctcggtattggaggcggtctgttgcggatgcccgcactggtccatctggttggttgtccgacgcatattgcgatagggaccgacctgttcgaagtcatgatttcaggactttacggcacgttcacgtacggtgtgaaaggccggatcgaaatggtcgcggtgctcgtgatgttaaccggggcagcaataggcgcgcagatcggaaccgtggcaacgaagtatgccaagggatatggaattcgtatcgcctttggactcacggccgttgcctgcatgatctcggtcttgttgaagcagttctcgtacccggggcccgcaacgatagtaatcctgggatcagtggccacgctgtgcctgtacatttgcatgattatgttcaagggggcaattaaagaattggccgagatcaaattccatcaatggaggatcttcaggcgaccgtgggagagaaccgcggaaggcttggaggttgcatgcaggacgaggacctcggagacctgtcaggagtttctgcaagacgccaaactggaatatttgatagactcgtttgacagcgacaagaactcccttgaaaacctgcacagcgttcatggcggcgggtttgcctggtgggttcgaccggcgcccgaccggccgtggaatgaacgcttcggagagttcgacatttcagagcagctctactcagcgctgtttcatctcggcatcactgaccgcctaaacgagctgcctcacgacgggcttctggatgcccatgaggaaggaatactgttgatgtccggtctggcacgtgcttcggaactcttgaaagagtcagccgagaatcttgtcgaagatagttatgaattgagttgcggcaaacgaattggtcccgaagagattgattgcaagatcgaggtcgaagcgaaaaccttgaaacaagacctcgcttctttggctgaattcttgcgctcggccggggagaagggctttgatgtgcaactgtggctctgaccgcagtgctgttccgtaccctcaaataactgctcggtcgcacgcagcgtccgtatgttcagcatgataccaggtcgctttcaaagaagtaatctgggcagactctttttgaaaaagggtttctccccagactctgttgagcgcgcatgagtatgaatcctacgtagcagccagccgcgcgacaggccatacaggaaccgaagacgtagactccactttccccggtaatcccagctaccgctacagctaatggtccggcttgctatccgaggaactcacctctgcgcactcctttgcctaagggagtttttcgagcaggaactccggcgcaaagtcagctccgttttgccacgaaagtgtgttgtaacggacttcgaagccgccgaagtaccgcacgtccgtgagtggttcgaaaattgggccatcgagctcgtcggacaggtccagctcccccgaggcaccgtcgtcgaatttgagccacactctgtgaccaccgagatgctttgtttcaatgacgtgtggtatcatagcgttactccagggagggaattggctcaagaggctgtttctcggccgccagcgcccaatcggcaaggagatccttcttgtgtaggaggcaccattcaaggacaagaccgagagcacgtctcgggaacccgccgacacgacccctttctcgatttcaaccgtggtctcgaattcccctaatgccgcatggaaatggggcggttcgtgatcgcgataataaatgtatatggagatcccaaggaatcgacttatctccggcattctgatcttccatccacgaccgaattcaggggactccgtctcaatcctggtttggaatcatattttcacccggaagcttcctttctcaaggcgaccgatgaagcgggcactgtcaagcggaacaatgtcgaggggttccgaatgctcatttgagggatctagagaaggcatccggcagctaccggccgtccgacgcgaccgatgcgtcgccctggcctgtgttacaaagattttcgataaatcggagtacctcacagagattcctctgactaaacgaaaggttgcgtggtattctcggaaggtgcctggtaccccgaaagcaggcaacccgaagaatgaagacgcccccgtagctcagagcagccctttccatggggcagaaataccggatctcacagcggcagcttgaggcggtgtttcagagattcaagtaagagggggctacaactaatgtagtagcctaaatcttcggacggtcgttagcctgtcttcccatttgtcaaacctttcttcggtcaagttcatccgcagatcttaagaaaggcggctccactgaaatgatcacactgggcatcgattacggcgcatccaatatcggtatggcactcgtccgtaacacatcggaagggaatgagcctctctttgcagcgaccattgttctggatgcacgaaggctgaaagacaagacggaacctcgtgcggccatacgacggctgagaaggacaaggaagacaaaaaaacggagactcggagaactgaagacgaagctcttgtctttagggatagatattgagactgtttcccggattgttcgcttctgcgagagacggggttacaagtccttgtttgatgaagggggcccacccaagaagaaggcggacgaggagctaacataccgcttctcccgggaagagttctttcaacaactgaatgaggagttggtgagcattctcgagtttgacgcaatggctaagcaggccctcaaggcctgtgaacgaattctcaatcgcgatggtgatcgtcaatttgaagtacggcccatacgaattgataatcgcggagtgagccgatgtgcatgggagggctgcaacaagacaaccccgaggcgaataaacgcgactgatgaggccataaaacagcaattggttaccttttttcaaggcattcttaaagaggaacctggcttcctggaggatatgagtcgagccgtttctgaattggatagaatttcacacgaaatcagagcagccattgagcggcaagccaccgaagataagaagatgcttgcgaaaaaggcaggaatggttttgaggaaactcaaggagaacctctggagttctgaggatgttgacgaccggatgaaaaaaacatgggagcacgtccgaaaagggataatgaatattctggagaaaggatacggcaggaattcgtattgcagacagcacactcaggagtatctggatagagtcctggctggaaaaccaataccgttcaagaagtccattgcagactccgatatcatctcacgtcgggagcaaatagctttcagtaaactctggcgttatatcgaagcaagaattctgccattggtccccaaaggaattgacaggattgtcgttgaacgaaccgccttcgatctcctggccgggagccgcaagaaagttggcaaactctcggacaagtctttggaacacatgtatcagttggggcccatgtacgggttcggcaatgaacacgagatgcttcggacagaattcggaggcctgtgcgcgtattgtggcaacccctcagatacgttgatcgagcaggaacacattttacccaggcgcgacttcttcttcgacagctacctcaatatcctgcccgcttgtcccaactgcaatgctgaaaaagggagaagacgtccgggcccggcttcgcttcacattagccaagcggcttacgaccgatattccgcgtatctcagtgacttgggaaggaaacggccgcttcacttgctccataatgaaaagaagggaatactcaatcttatgcgcgaccctaacagggcatgggaggtagatcgctatctcagtctaatcgccaacaacctggcttcaatagttcaaagccagcgcggtccgcggccgtttgcccgtttcctttactccaggctttcggaccgtcagcagaaagctcctgaaattagttttcgcagcgggcgtcacaccgcgctgtatcgcaacatagcctatcctaattttcgaaaagaccaggacaagtcagctggcggaaccattaatcacgcactggatgccatcctgctggcttctaagcttccggacccaacgccgttggaagcccgagggttgaacgtccacgacctgggaacctggtgtcgaaaggttagagcccgtgtgcctaaatccggaaaagacggcgtgcctgctctgccaggatatgactggtatgttccgggtttcgaaagtgtagacgccaacgggtatgccgtgatcgaaatggcgacaatgaattggaaccaaaaggacgccgcgactcacaagcaggacccctacggatggtctgcaagggcaaagaaacccacgaagagaactgcggctctggaactgtacgagaaactgaagacgaagaaagccaagagtgagattgaaagaatcgttgcaacgatccatcacccggcgctgagggcagctatgtctaaggaactcgaaacggcagatcccggcgccgcagtagccgaggcaatgaaagagtggcttcgggaatccgttagccaaagcatcaacaaatccgaattttcgaggcacccggccgaccttctaaggagacagcagctggtagagtttgcgaataacggtgggctcatacctcaagtaatagggatcaagcggttcgacaccggggttcagggaaagatagatttggagaggatcgacccgtttacaggcaagacggggcaccgttacatggcggacccggctaaccgggaagttgtcttggcgtatcccagcggatcagatggaaaagccaacctgtcgaaacctgtcacggcaggggtgaggcagaattttgcgctgaagaccggcggagaacgaatttttggtcctaagcctttggaactggaggggggtatagcctggggcaacggtacaccgcctaagaatggctggactgaagtgctcgaaacatatctcgcgggatgcggtttcagctgctacgtccgtctgactccatgctgcgtgatctgttaccaggatggcacacagcattttgtcaggaattttgacaagaatgacggtttcaagaagagcattctcgagaacgtgataggtgtgaggagaactcccttcacttccaagatcatgccattaaaagtgttgacacagaaagccgaaagatcgtaatagatggtcatccgttctttgacaaatcgtttcgagaaatcagttccggttgaaaagagcatctgtctgacaagcactccggaatagggcagttccggctcttgcggtttacggtgcggacacgtgtcgttgaaacacattgtcaggcgcgtcgaaagacaagatgtgagcccattttgaaactgattctttcatgcggttgccacatggtatctgatttcattgtcctgacaccggacgtttcaatcaaactgattctttcatgcggttgccacatgcccatgtcacggttgtgagcgccgagaatccggtttcaatcaaactgattctttcatgcggttgccactgtccgcactgtcacgaagcgattttcccgcaagtttcaatcaaactgattctttcatgcggttgccactgcaggaacgatttgtcaaagaataaccgaaagttaatgctcgtcttttgcgaatccccgcattcacggatctgacgcatcgggaatgctgaaattgatatgtcaggttagtgcgttacgtagccgggattccaaggcaaagaagttgattgcgaacctggctataacaaaagagttgatctcttgtgcccaacacaacagcttgattaattgaatctgtatcccggtctcgctccttggtgtggggagcttcgggttcgcaacgcattcttagactgcagctcactgtaggcgacttcctctcaaggacgtctgggaacatattgcatttttccgcaggggccgctttcgcgcgcagcccggtcataccttgctcacgcccttaccatcggtaacgtcaacggcccccagttgacagacatcagggcagagtgattactagcgcgtactcctgccttacctggttggctggtccaggtcttctgtctggaggatctctaggacctgccgccgaagctccggaacatcatcggtggttgttgcccagacaatatcccattgcaccgcaaagtatgcgtggacggcaatgttacggaacgccgcgatgtcgcgccattctacctgtgggtgtgtctcgcgaaatgcctgcgataggtgagacgcggcctccccaatcacagtgagcttctggagagtggcagccttgtgcagttcgctggccaggaacgtcgcggcatccatcccttccagaaatacctgaatcatctcgcaggcctcaaggatatcatgcaaatagaggtactcacgcctcatacagtactcgtgcggtggccagaacatggtcacgaatgacgggtttgaggccgtctttggtcaccaggtcaactttgagcccgaatagggcttccagatcgcgttgcattctggccagcgttacaaaggtaactcgtgccgttggatgaaagcttaccaacagatccacgtcacttgggggagaggggtcttggcggagcatggatccgaacagagctagctcccgcacctggtagcgacgacagacgctcgctagttcttcggcggcgatgttcagaggcatcgcttcattcatatcgttggctgcctcaaggccttctcgcatgtcagtgcaagggcacacgagcggctatggaccgggtgcactctcgggtctttgttcataatggcttggcctctttgagaatacggcggcggatcagccaatagagtcctttttcactcacaacatcgactctgcttccgagaagatcccgaagatcagccaagagtgctgcgacctccagcagactgcggtcaggctccatatccaccaacaggtctatatcacttgactcgtccgcttcaccacgtgccacagacccgaacacccggatattgcacgcgccatggcttgcagcgatcttcaggatgtcttcccgcttttccttgagtagctcttcaacgctcatgctaatgcccatgtcccaacctagcgcgtgaaagcgtttctcgtcaacgattaagtatggagttggtgtaatcccggatctgagacgagaacccgcgggatttctgtccgcgggccttgatccggcccattcaggacatatagttattgttagacggtactaacgttgtccccgggggcaagtgcatcgagcgttccgtcaatcgagcgagaggagtacttacggcaatgcaggcaattcccattgaccgaaagcgtcagccaacgatagaagtccgaccccggccttctgtgcaaatacatgtcgttacacctctttggggctcgccatccctcagcgctgcaatgggcgctccggtatatctcaagatggaagcattccagcccgtgggttcgttcaaggctcgaggtatcggccttgcatgcctggacagttgggaggccggtgcgacccgtctggtgtctgcctccgcgggcaacgcgggctatgccgtggcatattccggacataaaatcggcatcccggtcaccgtcgttgtgcccaagacgacgccagcctggctccaaggcctggtccgtagagagaaagcctcggtcatcgttcacggggattcctgggacgacgcccatgcctacggcactcagttggccgacgagcaaaacgccgcgtatattcatccctttgacgatcccagagtctggaaaggtcattcctcgatcattcacgagatcgtagacgctggtgtgaggcctggagccatcgtggtttccgtcggaggtggcggcctcctctgcggcctgctggagggtatgcacgatgtcgggtggacggacgtgcccgttctggctgtagagacagagggagcagcctcctttgcagcggctgtacgagcgggtcatctggtgacgctggaccgtatcacgtcggttgctaccacactgggagctcgcagagtggctgcgaaggcgctcgattggaccaggcggcatccgatcacgacgtggcaggtcacggatcgagacgctgtggatgcgtgtgtgcgattcgcggacgagcaccgtgtcctggtcgagcccgcgtgcggcgcgtcgctcgctgcggtgtacgggagagccgagccgttggaaggcctgcggcccattgtcatcatcatatgtgggggagctggtgttagtcttcgactcttggacgagtggaagaagacgctgggctaatgccgaagtaccacccaacgagtcgcgtttgaaagctcgtcggtacgatcgtgctctcgggattgcaattgcggttggtcgatagtcgcggtaatgtatatttacgatacgcgataaatctattttctgggcaattcattactgcttcatgagtctcgcgcaaggccaatcgagcgctgacggggcagtggacatgtcgggaaacccctcaacataggaatcaggacaccgaggaataacaaacaccgggatgagcgcgatccgggttggaggtagagtttcatgtacaaaaaattactggtgcctttggacgggtccggcaacgacgaggtcgtcctggaacatgtgaaaaagttggccaaggagtttgacgcgacagtgaccctcataatgctgcacagactcgcacccgcggaggacgcattcgagaaacagatgcagttggaggacggggcgtcggggtggcgagccaaacgaaaagccgagacttaccttccgcatgtcgagcatgtgatgcttgaggcagggattagggtaaatacggaattccttttggtagaggaacccgaggcagatgccattgtaaaatatgcggaaaaacagggctgcgatctgattgtgttcgcgaatcgtgagagatccccgatcggcaggtttttcttcggtaacgtcgaggagaaggtccggagaaggacctcactgccggtgcttttcgtctcggcacgcaaataataaggaggagagccgatgaattcccaaagcatggtcgaacttctgaaccggctcctggatgcggaactcatggccgtggaatactacgctatacacgccgatgccatagccaagccggaaatcgccgaaggtgtgaaggcaatccttcccgcagaacagaatcatgcggcaagtctggcggcacggatcaaggagcttggcggagcgcccggccggcctggtgggaaggcttcaacaaaaggtcgggaaatgggcgaaacgagcaagaagaatggaaccctggctatgctgaagcttgaactggccgaagagcaacgggctataaaagcgtacgccgcggcagtggcagatattctgcatgacatggtgactctggagatgctcgaggaacaactgttcgacgaaatgcgccactctaaatggctcaaacagagaataatggagctggaagaaaagccagctaacaactgaaaggatcgacgaccgatagacctctgactggaccccaatcctctacgaaccttgtcacaagtgtcaagctgccagtagacgtgcgttacgtgatgacggcatcatttgtatcctattcccttgaaaaacgagtagcagaaggtcccgtccggctctgccgttcgatagagatcccgaatccctgtagcccaggacatttcgtctatcaacccttcacggactgcttgcttgccgaccccttcaaccatcgcagtgaacgtcttcttggtgaagccatccactagggcaggcctgcttccgtccacatagaccatacgcggagaaacccgcacgtcgcgcaaaccggcctccacgagcagcgggtacaagcgacgtccaatgagggagtcgccgcctgctcgagcttgcagatctaccaggcactggatagccttgcgagcgtggacgctgtcgggatggaagtacgcggaaccgtggtccccttcgataacggttatcgatccgccgggtttcaagacccactgcagatggctcaacgcccctttcgggtctgacagatgctccagaacgaaacagacaaacacgtggtcgaaatgttgcggggcaaatgggagactgaagatgtcagcacgctggaacgtgacgttgcgaagacccgctgcgtgaacccgctcactcgcctgagccaacgagtcctcggacagatccaccgagacgaactccgcttcgggactgccggctgccagggttatcgtttgggctccgacaccgcagcccgcttcaagaataatggttcccgcgggatatgcggtatccgaatgcaacaatgccgtcaaggtggtcgcttgatcaaagaggcgtacactctcggtttctgaatacccgtgcacgtaatcagtggtcatctcttctcctgtcatgtgagccggagatcagatatgagccgaaattaccgtaacctcgcttccatttcaagacccgacctcactgcactctgcgaaggggcttggcacagagcggaagatctgataatgcagtaatcctgagattagggttcgaggctcctataagtgttttttcgcaacatcagtgaggtgtccatggtggcggcccacatcctagtatacgcttttgtggcagtgctcgcgttattcctgtctgcgggccgtgtggactggatgatgggatggatctatgtcgggtccaataccgctgccgtgattgccggtgcggctcttgtagcgcgcaaaagccctgatttacttgtggagcgctccacccatcataaggacgcgaaaagctgggacaagctgctttcgccgttcatagcgctccctggcccggcgcttatctggataacggccggtttagaccagcgtttccagtggtctcgcgcggtttctctccacgttcagatagcggctctcgcgctaatgctgatcggcgttgctctggttatctgggcaatggttgccaaccggtttttttcaactgtagtgcgaatccagcacgaccgcgggcatgctgt

SEQ ID NO: 114 - DNA, 11884 bp, Planctomycetaceae bacterium
  source 1..11884: mol_type = other DNA
ctccttggccgcgacgaggtactcctgctgctcgggcgtgaggtccgtctgtagggccagttcggtcatggcgatgactgcgttcaggggggtgcgggcctcgtggctcatgttggccaggttcgcggagaatgtgcccatgccccataccctggccatcgacttcggcgtgcggaacattggcctggcgctggtcgagcaccatgccgaacagggcgtaaccaaccgcgtgcgttacgccgcaacggtggtggtcgatgcgatttggctaggcaaggccgtgaaaggtcggccggaggcccgccgtattcggcgaacgcgcaagacgcaccgccggcgaatggagcggttggcccaggcactccacggtatgcccggcgatgagcacatcgtgcgtttctgccgccggcgcgggtacgcctacgatccgcccgaggaactcgacgacgcggccgagtcgttccacatcccgcgcgaacggttcttcgccgcgctggccgaagaaatcaagcgatgcgtcccggcggaacatcgccatgccatgctcgccgcgtgccgcaggcatctcaacgcctcccggcgtcgcgaggcggaactgcggcctgcccgcttcgagaatcgcaaccgggtcaagtgccgctgggcgggctgtagccggaacgttccgcgggcggggaacgactatcgcggccggttgcagcaggcgttgtacgtgtggctgaagcccatcttcgaccggtcggaacagcccgccaccctgcgtcgctcggtggaccattggattgccgaattggacggcctggcccgttggcgggcggccgcggaacagctcgacgacgacgcccgcaaagagcaaaccaggcggcgaacccgcgtttacaggaatctgctcgcgcggatcgaccgggaaatgcccgatgacgtggccgagcgtttccgggaggcgtgggcaaccacctaccgcggcaatttgaacgacatcgttacggggaagcaaggcggccgatgcacctattgccgcaagcactcggaccagttcgtcgacgacttcctggccggccgccccatcccgcatggcgaggaggtgactgaacgcgacctgatcagccgaaagcagcaactcatcttcagccgcttgtggcggctaatcgaggcccggcttcttcccctggccggcgggcggatcgaccgcgtcgtggtcgagcgcgtggcgttcgacgtgctggccgggcgccgcaagaaccggcagaagcttggggaggagtcggcagcggagatgtactggtacggcccgcagtatggttttccgtcgcgtctggacatgctcaaggccgagttcgacggcaagtgcgcgtactgcgacaatccgcttgcagaagaagtggagcacctgttgccccaaagcgagttcccgctgaactcgtacttcaacgtgttgcccgcgtgccgggaatgtaaccggaagaagggcgcccgccccgcctcggcggcccgcctgacggtaacgcccgaggcggttgcggcttactcgaaatatatcgccgggctccgcgtgcctcacctcttccacacgatcaagaagggcatgttgaccctcttgagccgcggcggcgacttagccgtggcggaacggcaactcgggctgatcgccaacaacctggtgaccattaccaacacgcagcgcggcccacgcccgttggcccgctatctggccacgaagcttgggcgggcgacgggacaccggccggaggtaggtttcacggccggccgccacacggccctgtaccgcgagatgctgctacccgattacgacaagccggcggctcgcgacgagggcgacctcgtgaaccatgccgtcgacgcgattgtactcgggtgccggttgccggcggccaccgtactggaaggtcagaagtggttccagacgccgggtggaatccggacgtggcgaagcgatgtctctcgggcgggacccgagcttgccggcgacgtgcctcgggtggaaggcccggaaccaatcgcgtacttcgaggacgacctcggggccggctatttccgcatcgacatgagcgcattcaactggaaccagaagcggaagtccggccaccggatggacccgattggtatgacaagggccggccgcccgattgaccgcgaaccgacggcggaggtgctcaagcatttgcagaaggcggcctcgcgaccgggcatgatcacgaggattgcgcatcccgccttacgcaaggcgctcgaggcggcgccggaccgcgcggcggaaacattcatcgcctggctgcaacagaccaccgaggccggcttgaacgccaatgctatggggcggcacccggccgaccagcagcgccaggcggtcttacggcagttcacgtccacgcccgtcgaacacttccttggcgacgacgcgacggccgacgtgccggggattgtgggcgttcgctgcctgaagaacacttccgccagtgtattcgatgtgccccgctccgacgcggccgggcgcgtgttccagcattacaaaggcgacccgcgcatcagccgcatttacgtgggctaccggcaccgcaatgggcaactcgatcgttcccggccggtggtgtactgcgtgaaccaggtccacgccgtctggcagcgcaccgtggggcgcgatatcgaccttgaccatccgccgggcagccccctgcgcggccgcccgctgggctcgacggaggagccggaaaaggcgttcctcgcgcattggcacgccgcccttgaccgcttgtgtgcgcaagcgggaatcgtcaagcggtttgtgctataccaaggctgcgtgctcgaaaaggccgacggcacccacttccagttgcgcaatttcgacaagagtcagccgtggatcaacgccaacacgttccgccatatccgccgggtctatcgttcgccattacgctttgcagcggaggacggcgcagggcgagacgtatgaagggtcgagtgaatggtctggggcgccgagaccgaaccagtgaaacagcgaatcgagcataaaatggcacggttgcggcaacggggaactcggttgcggccggcgggggagtagacaagcgagtgaggcgaacacaactgcacgcgagttcgctggcttgcccctgaatggcgcccggccgctcctacgaagtaaagcacaactggggtctgccgcacgaaggtttgcagcgcgtagcgcgcacggcccgggaatcgtccaatcggcgcgggtcgatcaggcacaccgtggcgcccacctcaacgcagtcggcaagccgttcactccgcagcacgtcgagcatgcgccacggatgccccagcccggttgtctcgatgagtagccgctctgggcgctcgtgtcgcacgacctggtcgacagcggcatccatcggcacgtcggcgctgcaacaaaggcagccgccggccacctggcgaatcaccacgccctgctcgggcattcactactcaacttgtccgaccggcaaacttgttgtatgctgcgtgcgtgccgatccagtaccagatattgatatcaccgtcttttacatacagcgcgcgatactgcatcgtaataccgacggaccaagtgcccggcttgtgactccctgtcttgcagtccttcaactggtggtggcgcagtgaacgaagttgaggatcggtatggaaccgcaaagcgacttttcgcgtcaactcctgcacgtcccggggaagccgcttgtactgttcgcggtacccactggtcgttcgattctgctgcctaaatgaactcggcagtctgtccatggcgggagtcttccagcgcttcatcccgcaaagcgacgaaggattgaggtaattcgtcaacagtctcgaacgcgtcgactatggcccgcgcctcctcgtagcaattctcgaactccccaagattctcgagatcgtagccgcgctgctgctggcggcgaaccgagttgtgtgcgtcgcgacacgcctcaagccaccgacgaaataggttgcgaagctcttcgtcggtagcctctgagtgctcgacttcgcccgacaaaacggcgcgtcgagtgcgcctgtcaagcctgatcagccagtggaatgcgtcgattcctaactgcaggaagtcctcgcactcgtagcactccatggcctcgtggtgttcgcgcatgacctcttcgtgccgatggaactcgttcacacggtcgcgaacaatgtcatcaagtcccatatcgaaacccctggcaggatggacgttgcgtagagtaccacttccgatgcggtgcatcaataccatttattcggccggtatccgtccccagggccatctctttatatcatgggccgaaaagcctgcggggtcaatgacctaccacaagaaacttatcgccccctgcgttcgggggccgttccagccgccgtgcgcctaccctttgactgacgctcatttggggggaaggggattcgttgcgtcctggcgtggtttctcctaagccgggttaatccacgacggggtgtcgcccccttaagtgactatggtgtatgctcttacgaacaatcgacccattgccaaaccaccatcttgcgggccggtgcggtaaataccgcagggtcacgctttaaaagttaaatctcgccagcgccgcgtttggattcgggcctggcgatggccgccgccaggcgatcgactacaccggccacgtcgtactccccttcgcggatcttccgccgtattgtgctcaccgaggtcgacgagaagcagacgcccggtttcgcgaagtgcccaaagagcagcctgcgccgggtgtccaccggagcgatacaaaagatagatcgcctcggtgaagcaaggccaggtcgtctccaacggcccactgggaaggactttcgccgccgcggcgccgcttccgtgatttgggtcgttgcggttgatgagcgccaccagcgggcctgtgtcggtgagaatcacaacggcccccgctgatgcccttcaagcaatgcttcggtgaaccgatggccgcaatcctccgagaacggttcgctcgcgccatcgaccgtgccaatgtgcccggccaagaagtcaaacagcgtttctccaggggacgcgttcggcgcctccgccacggcaaacgtgcgccgcaaactgtcgaggatctaacaaaggggacattactgattttcgggcgtcttgcgtggtcggccgggcccgcgcagggtgaattcgaggccaagtcgcgtggcgatcggatgcgtccaggagtcggtgcccaggggacgaccgcgttcgatgctccttcggatggcttggagcttctccgcggggagatcgtggttgacctgtgcgagccagttgcgcggacgcgagaccggccaggggctaaggtgggacaagtcgtgcgagtcccgccaacgaatgtgcaaggaatggatcatgccggctgatggtgggactcgctccacttggcccaccctacgcgtactcgtcccacgctacgtttggccggcggacaaggcggcgccgcaacccgtctgcggcggatcttcgacattcatcgggccctggcctgattttgggctggacatttgagaaaaacttgttatagtgtgcacgtgtatatgtatcaggcagcggtcgtgctgtgaagggattaggcgcgcggcagatggcaatctaaggaggttagggccatggagggacaatctcaggcttctcgtgacgccgagggcggcgaaatgcaagcgaagaccgggctcgcgatacccgagcctcaaacacacccggcgaccaaggcgagcgcggaggaagcgggcagccatcccctctgggcgctcgacgacgcggcactggacgacgtgcccgacgaggtcaagggggcgatcgacgacgtggtgcggccggcctacttgcgcttcgtcgtcgagacgcacgacccgatcgaacggtcgcttggcatgacgctcgtgcacctgatgtggctggaagtgctccagcaacaccacgcccaaacggaataccgtacgttcaactgcatgctgggactgcccgacggcgggtacgagcaaatgaaccagcagctccgcctcctgcagggtaaagtgcgactcggccagttcctcgtcaaactgcaagaggcacgcgagcggagtgaagcccgacgctcggcggggtcggaccacccacgggaatgcctgcccgctgcaaaaacggaaatggagccggaggacgaaccacaagacgaggacgaggcgcccttcgccgtgaatgccagtattcggccgccgctggacgccgttattgaacgacgggaagcgcgacggcctgaaccagaagagggatgagtgaccagcggcgaaaagcggaaattatggattttgttgaccaacagatcgaacgacgcttccacgcggtgcgggcacaaatcgtttcacggcaggcacttttcgctgtgcaggggtcggttctggccacctggcgaacccgcgatggacgccggttcggcccctactttcgggtatcctatcgcgagtatcgagggagccgggcggtgcagcgcgccatctatttggggcgcagcgagccgttggcccggcgcgtgcgcgagctgctcgaaaagctgcaagagcgccatcgggcccggaagcggcgtgcgaagctactggccgaagcccgcgcggacttcgcccgcgcgaaacgggaactccggcgcacgctggcgcccctgggcgtccaggttaaaggctacgagttgcggggggcggcccgggtggtgcgacggtcattgtccagcgatccgaattgatgaacaactccagcctacgttaccagcaaccagcgatggggcgcgtcgtgtccgggccaggcggcgggcggggttgcggggaagtgagcgccgccggaagcggttgcggaggcgatcgagcatgtggcggccggcgcgggccggtgctggttcaactgccctcgaaccagggtaaggacgtagccaagctcgacgcatttctggaagagttcaaagccgtgacccaccctgcgcggtggaaaatggccgtcgagttccgcaacgccgattggctgtgcccggaaacctaccacgtgctcgaccgccgccgggccgccctttgcctgcacgacatgccgccggccgcggtcgctgaaccgaatgacgccgccttcgtctacatccggcgccatgggccggcgggcgattaccgccactcctattccgaccgcgcccttcgcgaagacgcgcagcgcatccgccgctggctggaagaagggcggatggtgtttgcctacttcaacaacgacgccgaagcctgcgccgtgggcaatgcacggcaactgaaggaggagcttggcgacagcgaatgatgggggaacgccctggctagccaagggggtcacgatgcgaactccccgccgatgccgtaccgtctgatcgaaaaaccatgtttaccaatacgtacctgccccatgtctccggtgtggcccgctcggtggagaccatccgcgacgacctgcgaacgttgggacacgacgtgtacgtggtctgcccgaccttcccgggcgcgacgaaatcgaccgagacggtgctgcgagtacccgctatccagaacttcaacggcagcgacttctcggtgcgcattccgttgcccggcgccatcagcagccatcttcacgagttccatccggatgtcatccacgcgcaccagccctttctgctgggcgatgcggcgatgcggcgttgcgggcggcgcgcgagtgggcccggcccctggttttcacgcatcacaccatgtatgaggactatacgcactacgtgccgggcaatcaggagcgccttcggcagtttgtcatccgcctcagcaccgactacgccaacttctgcgatcatgtgattgccccgagtgaaagcgtcgccgagttgattcgccggcgcggggtcgaatcgacgatcacggtcataccgaccgggatcgacctggccttcttcgccggcggcaatgggcgaacgatacgcgaggaattgggcattcccccgagccgcaaggtgatcggccatctcgggcgcctggcgccggagaagaatctcgattatctggccgaagcgattgccctctacctcggccaggaagccggcgccggaagttgttgcctcatggtgggaggcgggccgtcggaagagccgatcgagaagatctttcaggggcggggcgtagccgatcgcctgtacatggccggccggcgtacggggcaggaactggccgatgcgtatgcagccatggaccttttcgccttcgccagcaagaccgagacgcagggcatggtcttggcggaagcgatggcagccgggaagccggtcatcgcgctggatgcggccggcgcgcgggaagtcgtccattcgtccgaggcgggacgcctccttcacggcgatgccgacgtggaaacctttgcgggcgctctcgcggagtttccccttgcgggagacgcgtaccgcaaacatgtcgatgccgccaccgaacgtgcccgcgtattcagccgccaacactgcagtcgccggctcgccggcgtctatgagcaacttgaccgggaggcgcgccgccagtccgatgacgagcggcacagcgcctgggatgcgttgctcgcccgcgtgcaaaccgaatgggaactactagccgcccgagccagcgccttggtcgccgcagcggaagccaaggaggactcaaaacgcgagagataggagattctccgtcaggttggggtggcccggaagacgtgacgtcgttgcaagcgtcagaaccctaccgcccgcatcagccaaacgaccgccggcaccgtcaccacgctggcgagggtgctgacgaagatggcccgggagagcatgggtcctgacggacaaccgtgcttcggccgggccgacggccggctcagggggccgcatgccgcacgagatccaggaaatccctggggctgagcacggttgtgcctttgcatgccttcttggggaagtgtcggaggtttccggtcaccagcatggcgcccccggcggcggcagcttccaggaagggcaggtccgcagggtcggggagggaggtcgcaggcgggaccgccgccaccggctcggcgatagagcgaatccattcgagcacgatggccgcatcctccggacgaatgccgagttcgcggcggtacagcaccgattcgtactcgtcgagaatcctgtcgtcggcgcacagatcgaacgcgccgtcggccagcaagtcgatgatttgggcgcacgtgccgcccgccgtcatggcggccgagacgatgacgttggtgtcgagcacgatcttcaccgtgccgctcgcctttcgcgccgagccttggcgacgacggcgtcgatctggtccatcgtcaggcggtccaggctgtcggccttggccttcgcccggatgcgtcgcagcgcggcctgggcccgcgctcgccggatggccaagatctcctcttccaccccgtcggggtccactcgagtcatgaccgcaaacggacggccgttggccgtgacgaccacctcgcggtcagcctgaaggtcttggcgaagcctcgccgtgttgctccgcaggtcgcgaatggtgatgaacttcatccgttgtactcccgaggacaatgcacttgaacggtatctttagtgtacgcaataatgcgccgattgtcaaggagcctgcgtcccgttgggtacagccgttcacgggggacggtctcaatggaatcgcgggaagatcgggaacttcgcgtcagaaccctaccgcccgcatcagccaaacgaccgccggcaccgtcaccacgctggcaacagtgctgacgaagatggcgcgggagaccagcggcacgtcgccgccgtatttctccacgacgatcgagcaggttaccgccacaggcatggccgaaatgatcaccacgatggtgagagtgtccggcgccaaccgcaggtttaccaactccgccaacccgacgagcaggaggacggccgccggcaccgcggccagccggacggccgcgatggcgaccacgtgccggttccatgcgtcgcgggctccggcgccggccagcagcgatccggtgacgatcatcgagagcggcaccgtcacctcgccgacgaatgccgccgcctgcacgatgatgctcaaggcggcgagcgacacgccgacctccgtaacgtccagctcttcgagcgtctgcgtccatggaaaggccagggccaccgcaatgcccaggatcgttgccagcaaccccgggttcaaggcgagctttcgcaacgaggctaggtccggcttgcccccacgtacgatccacacgcccgcgctccagaacaccaagagcgcgccgacgttgaagagcaagacggcccgctcaccttccgcaccgtacagggcgatggcgatcggcagtggaatgaacaaccagttgggggagccgatcgtgaaggctaccgagccgcgatggggctcgccatccttattcagcaacggcgagacgaggtagccgatgcctccgcccaatagaagcatgcccgctccaagcactggcaaataccagctttgcgccagcttctgagcgtcgaccgtccgaagcatcgaggtgaataccagcgccgggaatgcgacgtcgaccgcgaagttgctgagcatctccgtcgcgcgcccgtcgagtaacttgaacttgcgcacgaacaggcccgtgacgatcacgaggaacagcatggcaatcgtttcgatgacgcgaacgacttcgtcagtcactggggccgttcctcattccgcgagtttctacaaagggtcgctgtctgggctgcgcaccgtcaccgggcggctgccatgtcgctggggcggggcgtgctccgcgcgggtgtccgccgcttcatggataccaatgaggaactcgttcctgttcgcacaccgcccccttttcacaggggagtccgatacacagtattgtcgagccgctcttaaccggcgacgggcgtttcccggagatcgagcaactcgacctgttcgggccttggccgcagccagtcaagccaggcggccgagccgtcggccagcctgccgggattcacaaccgtggtgccggcgatctgctgcacgccgcggtgctcggtccggccgccgacggcacacaggtcgggatggtagctgtcgatcagttcaccggcaatcgcggctccgtcgcccgcgccgcccatggggccgggaggcggtgccccaagcaggagcaccttgcggggcttttcgaccgcccacaacggccgcagcagatactccgccacgctgcgcgatacccgcaccgagtgttcgccggtatccacccattcggtgagttctcctccgataccgcagatggcaacgtcgcgattcgtagccagggcaccatgtacgaggtgcagtttcgggttctgaacctcggcccccatgccaatgcgcaggaactcccgcacgggcacgtcgtggccggcgggcacgagcgccgtgaaaacgtcgattctcgccatggtttcaaaaaactcggcgtaccactcggcttcctgcggcgtcaagtccttctttcccgtgcccctcgctcgttgctcatccggcttcaggatgccgccgaggaacaagatgccggcggggcggcgttgttgaaccgcctgctccaacagttccagggccttgtgcgatccatccattccaccacagatcagccattgtctcatgatgtctcctccgcgttacgggtcattcgtgggttaggcggtgtaaaacaataaactaccgggaacttcaagcgtgggataggcttccagcctgtcttttccggcgacaggctggaagcctatcccacgcaattcggtaggttattgggtta

SEQ ID NO: 115 - DNA, 17241 bp, synthetic construct
  misc_feature 1..17241: note = Synthetic
  source 1..17241: mol_type = other DNA
gtccacgacaaggcggactcgacgacggacttgcacccgcgttccatcgcggcgtgactggcaagtgccgctaccctccaaggtcgcgaaaggcatccttggagatgtcggcttgttgtaggtgttggcgcgtcaatgcttggtggcgaatttgctcggattctggcccttcacggtgttcacggagttaacgcagtttcacttactttgtttttacctatcgcagggaaatccgactagtagttggaaacaaagtagggaaaaccgcgttaagcgcgtgaagtccgtgaatgggttcggtgtggaattggacgccagccgtcaccacatccgccgcgtctcgctccgctgggttcaactccgcgccgatcacggccgagccgcacgaccagcggtaaaaaggcaggcaggggaggccgttatagctggaagaagtcgggaagcaatcgtgtgtggcttgccactgccacgccggcgcggtacggtgcccaccgacgagagcaaaccgcgtgaacgcgacagatgacgaccgacgagcggcccaacgacgaacccgacggcatcgacgccggcacgctggagcggttcacccaactcgacgcagaggagcaggcgcggatcatcaagctaacgcgacagccggctcttgatcccaaggtgccgaagcgggatcgcgagatcgctgaagcgcaggcccggcagttggaagccgctcgacgccgcgctagacggtatccgtcggccggctgagacgggtgccagtaattgcacgaagccttgaacgacacaatggaccgtcggttacgaaagagaccctcaacactgaagtcatcgccagcaggctcaatttaatttcatgggttatgaaaatctcgatcgcggaatagaggtgggagattaactgatgctgcgacgaatggaacagttcgacgatgtacggctggcgtttgccactctacgaggctacatcgagcctggaggaaccctgaatctgaccgagatcaatattcatgcggaggatttcgtcggcgaagtcctcaacaggctgtacggttgggctctagtgccaaccaggacaatgagcgccaggtatcccggaatcgatctgctcgaccgtggccaaaagctcgggattcaagtgactgctgaggggggagtcgacaagataaatgacacccttcgcaagctggcgacgagtggtggggcagtggagatcaatcagctcaaaatattcgcgctccttggaaaacaggggtcgtatgctgttcgggatgcgtgtccgggcatcgcgttcacgtggaaaaaggatgtggtcgatttcaagagcactcttgctgacgtcctcaatgcaactgaaccgaagcttacggcaatacatgaatacgtgacgagcgaactcccggctgtttttgcaagccgacgcgaaaaatatgaacagatccgcgatcaattgaaagagaatctgatcgttttcgatcgcgacgtcatgcgggtcgccgatcggtatgaagacccagtgctgatgtgtcgagcgatccgatacatgcgaacgaccctccagaaatcaggtgccgcgcgcatcgcaaatgaggtggcggcaaagcagtttgatgtggcgcaaaaagttcttggtgaaaccgaacgagcgataaaggttcggtttccatatatccacaaggcggctctggagttaccggagcagcaatcccttcctttcgacgcatataagaacgacgactatggcgaatcgattcgcacaatgatggagatgcggccgaagctatcaaccagcctgcaagcattagaggacgaattgcggagaatcgaagaggtgttgtaacattctcgccgagagcgcgctgtaatcccgatcgcacctgcgcgcgttggtcacatcgaccagtgcattggagttgcaaagccatggcccatgctgcccaggatgcgtttcatcgccaccgcccccggtcccgagacgcataaaagccttataacatactcttgactgcacgatcaagagtatgatataatgcctccgttggggtaggaggaggaaagacatgaagaaaatcatcgcgtactaccgcgtatcgacgaagcggcaggggcaaagcggactcggcctggaggctcagcaggcggccgtggaagcctacgctcgccagcatggggccaagatcgtcggcaactataccgagatcgaaagcggcaagcgcgccgaccggccgagactcgctgacgccgttgggcacgcgaagctcgcgggcgccacgttggtagtggcaaagctcgaccggctcgcccgcaacgtggcgtttctctcggccatgatggaggcaaaggtagatttcgtcgccgtcgataacccggcggcgaacaagctgaccttgcacattctggccgccgtggcggaagccgaagccgaagcgatcagcgcgcggacaaaagccgctctttccgcatacaaggcccgtggtggccggcttggcgcatcgttgccccagtgccgcaacttgacgcacgaagctcgccagcgcggcgcgaaggccgccggcgaatcggtcaaggcaaaggccgacgacgcctacacattcctctatcccacgattcggcaacttcggactgatggcctgaccttccaggccgtggccgatcggttgaacgccgctgggcactcgacgcggcgcggatcgacctggacggctacggctgccatgcgagtctgccggcgagccggggccgcgtagcaaccgtggtcggcgccgcccaaggcggtcagcgctggcatcgtgtcggacggaaggccgcgaacccggcggtttgcggcggacgaaacgcggtagcctagcaactttcggcgagcgttgtcaaaggagccgaaaatcgggtagtggtgccccaggtgcgttgctgattttttggccgggtaggcgtgcctagttcttgggcagaagcaagtcaggcaaatattgcagtcacggcggtcaagatcgccatctgcaatatccacataaccaccagcagcaagcaccatccccccatcaaaggcattcgcggatagcagcgattgatgtcaaggaacgcgcaccacaccaggaaaaacccaatcgcggccggtagaagtatcgccgatggttgcgccaaatagacatttcttatccctgccacaaatgcagtccccgcgaatccgagaacgaacgagcgggcgtgccaattgccgcgattcgccatccccggcgacttgtacgggttctcgtccatgctcccattctaccggggctgccttgtgaggaggaagtggcgggcggtggcggcaagtgggctaatgctgtggtggtcggtcgtcgccgacgaaacgcggtagcgtagcaactttcggcgagcgttctcaaaggagccgaaaacggggtagtgggtcgtattgaattcgggattttttacgccgacggcaagccgccgtggtagaaaggggtgcgcgttatccaaactggcgcaggtccatacccgatcagaaccgcaaattcgctgcccattccgtcgccgcgcaattcggcaacaatcacgtcggccgtattcccgtcgttcataaccaagcgacagaggcccggttggaggattgatccccacgacagaattgccattcctccccaccaattgccatcggtgtcgagatttagccgtgtgatctcgacttcgcgctgattgcctatcagcctgccgactacaggatcatcaagtcgagacatcgcacgaccaatgggtggtgggggaacggctgcgttgctggcgaagacgggccggatgcctaatcggtcggcggcggtgccttaatcttggcagaatcgtgccgtttgctgaagtgatcggtaaaacagtttatcgtccagagaatcaggagcagcgtggcgttaattgcgacaaaatacagcgtgaaaaggacgccaagagcgaattgcccaaccccgactttcgctgcgatggcggacagcacggccacgattgccgtgaggatgaacagcgagcgcaagcggaattgtgggcggggcattatggttcgcccggcgccggaacgccggtctggtcggagtccatcgttagaaccgatcgctcgccggtcaccaccgcatcccaaacctcccgcgtaataacgccggtttcaacggccttgtcccaggcggtgctcaagcgacgtttttcaaggcgtcgttcaagtcccatccccccgaagaagcacgcggcgccgaaaatcagccagagcagcgtcgaaaggcggaactgaaagcgggggcggcgcatgggggtattctaccacccgccagcttcagcggaccagccaggatcgcgctcttgcccgccgcccgcgccatgccgctgaattgtagcggcggcttcgttccaggcacggccgccataattcttacagcgagaattatctgatggcctttcgctaactgccgagcgcaaatccctgccggacgtggtcattgcgggttggcctgtcgccgttcaacgggcgttgatgcccgaaccgtgggcgattcaatcgcgtccttttctgcgcagagatgatcgagacgatcgctagcgcgttgcatccgcacgctcgtgcgccttcttggcggcgttaaactgcgcttcgagtttcgcatccatttcttcctggaatttcacagacttggcatgttccttctcgtggtcggcgaaaatcttggctgttcgttctctaaaatgcttggattttgggtctagccaccctttgccgagcgcctcttcgtaggctgcctggagcgttaccatgtcttcgcggtgttgctctgtttcttccttcatgcggtcgtaaacctgacgttcggcgttgtaaagctcgaccgcttctttgtgcttgtgctctttggactcgcagccggcgagaggcaaaacggaaagtagggcgaacatgagagcaagttttcgtagcagcattggcaattcctccgatggtaagaacaagcagccgccgcaattccgagccaccgacgttcgggccgattgcgtcatggccccggatcgctcggcgtactggagcgcgctggcgtggaagtcgaagcggtgcccgctcgacccgccgaagtggtcctggccttggcgatgaagacgacaggcaagacggtgactgccgagtcgatgactgcgcccagcaccagagcgccagcgcttacgtgaaacccgttcaagtggatggcgatggcgttagcacacgtccagaacgccatgctgaacacgaaggcgatcgcgacctgcgcccgtaacgaaaacggcagtcgcaggatgccgagtccgaaggctactgccagtgcggaagtcatcgccgataccatgccgtttacgatgagttggtcgtcgctgtcggacggcgatacaaggccgatcggaacggcaatcaaggctgttccaaagagccagcacagcaaggccgcgttggcgggggagacgctgttgtctggcggcggcctcaaggcgtcgatcgacagcttgacgccgcaaccgcacttcgggcaggacttggccgcgttgctgactggctggccgcaatcgcggcacttgatgagcattgatcgttctccctattttgtagacaattcatccttgcgcttttttgccgcatcaaccactttttgctggtcggccatctcgcgttcaatggccgccaagcgaccgtcaaaatccttggccgccttagcaacggaggcttcaatcgcaaggctttcaagagctttcacggcgttctctggcttgccatcgttctcgatttcgctcttgatgttgtccgcgatctcatcgacgcgaaatccttcaaggttggcaccattgtcggcacacttcttgatgagatttgcaaccttcgacttgatctcggcaatgcgattgtcctccggtcggcgagcttcttgcgcttccatatctatcttgtcgcattcgttctcggcgagctttagggcagccgtcgctttctcttgatcttcgagaatttccgtctttctgctgggatcgaagtattctccgactgcctctttgtattccagtttcttcaggcgcagactcaactctcctgccgtggtaaggagacgctttcgctcacgcatgtacttcgacttccgaccttcaatgtcttgaacgcgctgcatcgtgtcggctttgagacttagaatatccgcgctaaggcggtagccggcggcggtcgcgaccgagcgggcgacttccttcgcttccttcatctcgcggacacatgcgtcgtgctttttcgcgatcacagccaggccttcagactcggcgttgtacaagtccagcgcgtccttgtacgacgggcctctcgtgaaagcaaatcccgccagcaggacgagcatcacgcttgcaaggcaaacaccgatcaaggcgggccacttggaacgcatcaacggcatcgtcgcgcgcaccggagcggttgcgagtggaactgtcggcaattgtggaattcttacagggaccgcgacaggtgcgacggcatggacggaagccgcgattggcggcggcgatcggccgatcaccaccggcgcggattgaggggccaagtggtcgaacagccccgtgacctgggatgcgtcaacccaacgaccatcgttccctttgcggacgagatcgctcggcaatagctttcggtcacgaaccattcgacgtaattcgttcgggctaagcggaccaaccacgtcgcccatgagttgggcataccattcgctcgtcatcggcgtaccctttcccttgtcagttatcgcattcgatatggcatcgactccgtgttcggaatcgaacgactcgaatcccacgacgcgggttggtctggtagcgatgggcgcgcgaaaaaaggagcgccgaaccaaggccactcctcacacggccgccaagccgtcacaagaacagcgcatggccgacgctcccttgcgagaagggagcgtagccagcactgcttcttgtgatttcaagagcctctcggcccaagttggcggttcgtgaggaagcaggaccgacgtatctcacgtcgttcaaattgtcgcgtggctgggtgggccaccaggttttcccgaaaaactactccggaacagaattggttaatcgtaagcggtgctcaacccgatttgcaactgccgccggcgggtttttgggcctttggtctggtcgcccggcggtggcgtgccgtggaggagtcggccacggactggagggatggacgacctagcaaacccagccaccggcagcgcgatccggccgagatcgctcgcaagcagacagttcggtgacctggcccgatcgcaggccgagaatcgtcaccttgccgatcgcagtggtcatcgcgtgccgtggaggagtcggccgtcacagcacctggcggcgcgcccggcacgtcgattgggaggttcgtcgtaatccacgccaagccagtcatcagcgttcgacctgcaacgacgtggccggaagccgcgatcgttcatgctgaacgattcccaaacgagaggccgcgatctgctcgccacgtcttgatcgaaaaaatgattgacaatgagcttggcccctgtatcgtgggggcgtggccgggaagtctcggcggctctttggcaattcaaacgaattcgtgtggtgtctgaaaagagccacgtccaggagtccggcacccgtggattggacagtctacggccctgcacggccggtatagagaagccggccaaacggccctggccaatgtggtgagtccatttttatgtttgttgatccggaagcggagtttcaggcgacacgaacttttccaacggcctgcatcactccagtcggcagatgctccgcaagccgtcgatggtttcaggcgacacgaacttttccaatggcctgcatccggcactccccccaggcctttctaacggcctgcatccctgggaggacttgcgcggcgaatccctccgatcccacagtttcaggcgacacgaacttttccaacggccttcatcatcgcatcttgcccgtctactccgcaccagccggtttcaggcgacacgaacttttccaactgcctgcatcaactgggcaatccgttcgcgtgcggtcgccaactcgtttcaggcgacacgaacttttccaacggcctgcatcatccatgcgcggcgcaactcgggcatgtcgccacgtttcaggcgacacgaacttttccaacggcctgcatccaactcgaatcactccccgctgtactcgatgaggtgtttcaggcgacacgaacttttccaacggcctgcatcggctgggaacccatgtattgtttagtccccagaagtttcaggcgacacgaacttttccaacggcctgcatcccaccccttcgcccgttcctcccttcgtgccgccgtttcaggcgacacgaacttttccaacggcctgcatcgcttcggttcctggatctggactacttcgatgatgtttcaggcgacacgaacttttccaacggcctgcatcagcactcggcaagctgcgatggaagaagaccaccaagtttcaggcgacacgaacttttccaacggcctgcatcctcaaccgtgcccgagcctcaacccgaagaagtgccgtttcaggcgacacgaacttttccaacggcctgcatcgagatcgccaaccaggtcaccggtgccgcggccatgtttcaggcgacacgaacttttccaacggcctgcatctcgacgtgtttgcggcacatatcgacgcactgacgtttcaggcgacacgaacttttccaacggcctgcatcacataagcctgcgccttgtcgaaatgcgaatcaagtttcaggcgacacgaacttttccaacggcctgcatcttgagcctttgagcctttgagcggtgaattagctgtttcaggcgacacgaacttttccaacggcctgcatccctactattacgaagtcacagcgatcaacaacaacgtttcaggcgacacgaacttttccaacggcctgcatcggccgccgttggcgcattcggacaggtcgggcgaagtttcaggcgacacgaacttttccaacggcctgcatccccgagaggtactggccgttcgtcaatcagcacggagtttcaggcgacacgaacttttccaacggcctgcatcttggaaacccagggtcaagggtagcatcctggatgtttcaggcgacacgaacttttccaacggcctgcatcccgggtggagttcgctcgccggctgggggtcagcagtttcaggcgacacgaacttttccaacggcctgcatcccattggacccaatcgggttggtgagtgcggccgttgtttcaggcgacacgaacttttccaacggcctgcatcgtaaaggtagtacgccatgcggcggcacgtgcgggtttcaggcgacacgaacttttccaacggcctgcatcccgccggaagagccaccggcgccaaagcccgacaagtttcaggcgacacgaacttttccaacggcctgcatccaagatcaacgcggacgtcacgcagaatttcgacgagtttcaggcgacacgaacttttccaacggcctgcatcgctgcaacgtgccggcctggccgttcgtgatcgtgtttcaggcgacacgaacttttccaacggcctgcatcccaccggcgccaatcaatccggctgtgtcgacgtgtttcaggcgacacgaacttttccaacggcctgcatcgaggcgcacgcgccgcatggcggaccgtggccgggtttcaggcgacacgaacttttccaacggcctgcatcggcgggtttttaagtcgaagtgcgctcactacttgcgagtgcgaaatcgcgaaccccacggataccacttgcgatcggatgtaggatgactttggctcggctcataaatactgggcggttctgcttttacgacgatcgcgaaccccaccgtgttttgcacgtcactcctggttcgcggaatatcgaaggtcgcttccatgactcatacgctttcgattgacttcggttcgacgtatatcggcctatcgctgttggcgcacaacagcgccgacccgaacaaggtcttgtacgcagcgacggtcgtcgccgatcccgcctggcttaccaaaacggttgaaccgcgcggccagattcgccgaatgcgccgcactcgaaaaacccaccgacgccggttgcaccggttggcgcaagcgatggccggcatccagggcgcaacgcaagttctgagtttctgccggcgtcgcggttacagccacgacagtgacgatgatgaccaggatacggcggcgttccgagtgccgcgtgccgccttttttcgagcgttactggcggaagtcgagcgctgcgtgccagcggctgatcgcgagcgggtgcgcgcggcgtgttcgcggcacctcaatgagcagcgtactcctggcgcggaacttcggccggcgcgattcgacaaccgtggttcgtccaggtgccaatgggccggctgcaatcacaacgtgccaagagccgaaaactgtgcccaagaaaagctttcgcaggcactattcgcgtggctcaagccggttttcgatggctccgccgatccaattcgcttgcgccgttctatagaccattggattggcgagctagctggtctttcacgggcataccgccgcgcggccaagctggaggacgaatcgaaacgcgacgaaaacgagtctggcattaagcgtcgcgtcaagcgcgtgtacaagaatctcaaggagcgggtttgtcgagaagccacaccggaagtggccgagtcattttctgaatcatggaatgagttttatcagaagaacctctccgagatcgtgtacggcaagcgcggtgggcgcgccaaatactgccgagagcattcccagcagttcgtcgaaatgtttctcgctgggcaacagattccgaatcggcaagacctcagcgaccgcgatctcgcttcgctgaagcagcaaatcatctttcggcgtctgtggcggctacttgaaaaccgggtgctacctttggctggaggtacgatcgaccgcctaatcgtagagcgcgtcgcgatcgacacgctcggcgggttgttcaaggatcggcagcaaatctccgacaagaaggctggcccgctctactggtacgggccgcaatatcgcttcaatagccgcctggagatgctcaaggaggagtttgatggccgatgcgcctactgtgggcaggcggcaaacttggtggacgttgagcacatcctgccacacagcgcattccccttcgactcgtacctgaatgtcgtgcccgcgtgcgacgattgcaatcgtcggaagggtgctaggacgccgctccaagccggaatgaccatcaatgagaatgccttcgacgcctacgtcaactacgtgcgccgtcagaaaccaccccatcggctccacgaaatcaagaaaggaatgctcaagctgctgctccgacctggccaagacgggcagccggaacggatgctggggatgatcgcgaacaacctggtccaggtaacaaacacacagcgcggtccgcgcccgcttgcgcgatatctggcgtcgaagcttgaaacagctactgggaaccggcctgcaatcgccttcgtcagcgggcgacacacggcgctctaccgtcgcgtggtcttgccggaatacgacaagcctgccgaaaaagaatccggcgacgttcgcaaccacgccgttgatgccatcttgttgggttgccaatttccgtcggcagcggccctggaaaaccagacgtggtatcgcacgaccgccgacgtggtgacgtggtgcaacaaagtccgcgctgtgtccccaccgctcgatgatggtgtgccagaggtagccaggcacgacctggttcccttttttgaaaccgaccttggcggtggctacatcggcatcgacctgagtgctttcaactggaaccacggccgacgcggtacccatgatctggacccgtttgccatcacacgctccgggaagccggcgaagcgtgtgccggcggcgaaagtgctggcagaactactgttggatgccggcagacgagacaagcagatcgcgggcattgccaaccgtggcttgcgaaacttattggaagccgcaccgcaaaacgccccaatggcgtttgtcacgtggctacaacaaacgacacgcgatgggttggccgacggcacgatgggtaaccatccagcggatcaagctcgtcgtcagcaattggaaaaattcgtcgccgcgaccgtggaaaacgtgatcgctgacgatgagccgataccggccgtcgtcggagttcgctgcatcagcaacatttctgccggactggtggaagtgccgcgctgtgaccgatctgggagagtccaccaacactacaaggccaatccacccgttagggagttctacgtcggctaccgctcaaaggatggcgcgattgacggcagtcggccgatcgtattctccgtgaaccaagtgtacctggttcggcgcgaagaaggtgggaagaaggtcgggttggatttaccgccgggcagcccgctcctgggccggccgctcggagcgcagggtcggctgcgtgacttccttgtggcgtggcggagtgcatttgacgagctgtgtcgggcggagggtatcagccgccgttttcgagtcacgcaaggttgtgtgatcgagaaggtggacggctcgctgtttcaactgcgcaactttgacaagagtgaaccgtggaggaaggcggcgtcgttccgcaacatacaccggattcaccgctcgcctttaactgcgaccgatccctaagctcgcgagacgctccgggtgggccgattccgactaatggcagccggcggcaaagcaatcgtgccatgcccaggacgccgaattgccggctacgcgattccctttccggccacggcctcttggtaggccgccggaacgtgcggcagtatccggctttcgggcaggccaagatcagtgccaaccatcggtagctcgccggcttcgtcgatggcctcccactccttttccattcgaaacgcatccacgtcggtgggtgcttcgggaagcggcatcttatcgagacccgcgaacttgagaatcgccgccgctgctcgaacgtcacctttacgcgcggcggcgaccaaggtgttgattgccgtcggcagcgccgcacgcaaccgctcgttggccgcgcgaaaaagctcgtcgcgccgtacccgaacggcagcgagaaagcggccatcatttagccgccacttcgtcaccgtcactcgatgcacgccaatggcttccgccacttccctatcgttgttaccggcgacgagcaggtccacggcgacgcattgttcgatggttagcccgtgtagccgcttgtagccgtttgtagccgcctgaaccataagttgccgcctttcgtcaccagccggaggggtgccccgttaccgatcgtgctgcgtccgccggttcgccggcgatcacgcgaaggcagatagagtctaacgcatctccagtagggcgcgaattagcggacgccgtttcgggaagcgggagatcgacgacttcgtggaaggaaggctcgcacacagtcccgattgtcccaccgcgcgaactacgatgcggcaatggaaaggccgttcgggcagcaactcccgaacggccaaattccaaaaaccctggattatccaggggcggttcaatcaacggcgacaactccgttgtgaacctggtcatccacgaaggtagattcgcgaatgcctaatcaccattctaatgccggcaatcgcctgctgcgagtcccatccttcgtggccactcggctagcagtccgcgagagacgcttcggggtgctcgtggacgtcgtgcgtttgcccgaagcgaccacaaatcgggagaatacagctacgggtcgcctttgcgaacagatcagccttgcgtgttgcggagccgcgaaatgcggtatccagcggcatcccggaagggtaatccgcgagtgaatcttgcccaagggcgagaaaccgcacgaacgctgaccaagggacggtaaacccaaggccaagatttgtgagtcagtggcgacgtgcctgggcgcaagcgattgcgccggccccgcatcagacagtacagtaagtgtcgtcgcgaattttacgaaactaaggggagggtggtcgggggtagggtgacgcgcgtgcgactttgattcaaatgacctacattcacgacgcaatccggccgtgcagacaatggcgcacaaccatcgcggcgacgttgaatggttcaacagcgccacccaggtcgcgaaggcatcccttgagtgcggttggccttcgtgggcgtgttggttaggtcagggtgtgttagccagcgctggtgtgtcctggccaggacggattgcactggtaagaacgtggtgaacgagttagcggccggggcggcaactatcgctggcctagcgatgaagcttcaacggcggacaccacaccagcgcgctcggccagcagcgttgtccggcaccaacctggctcaccaggatcacggcttacgcgggttcagcgccgagatcgacttggacaacgctagccggtggcctacggcttggggaccacgccagcgaaccgcgaatgacgggcgctggggattccacagacgggccgccttgccggccggcgaattgcttgacgcgaactggctgccgtcgccgaaattgctgggcaggtactcagggaagcgtcgattcgcggtggtggcaaggtcgcgatttcggcggtttgccgcgagcgtggtcaaaggagccgatgcctagtctttgggcggcgctgcctgatctggggcggtggtgctcgaatcttgttgtccagagcggcccttgatcttcgagccgttccatcgccgacctctgattcggttgtagcgttcccagttatcaaccgtcgcaaaagtgagaagcgtgagggacgccactacggcgctgaccagcatgatccagatcagggtgttcaaccagaattgaaagctgtggcggcgcatggcggtattgtagcgggaacgccggtcccgtggatcatcaacttgggtggccggttcgtgcggcgggctacccggctgggtcaggttgcccggctcgccaggatcgcgtctgaagctggttcggcgctgggatcgacctatttcttgatttttccagaaacgtttgcgatggcgtcggcggtacttttccgcttggcagcctgattgtgcttgtgaagatgttcatccaaaatcaattccattccattcttgaccacttcaaaatagtcaagacattcctgctcacttagttcatggatacccgtactgaggattccataaatcctacgattctcgacgagaaaggcaggaagttcatccttaagaaagagaatcttctcctccatccgtagctgtttctcaaattcggtttgatcccagcctggcttttgcgccgcggcgatccgtgcttcttcgatcaatttttcaaaaattcgccgcaagtagacaaacgagccgatcccgacgccgtgtgctcgcaagccaatcgccttgctaaattctcgttgctgttcatcgcccagtacctttttgtatttcttgattccatacagttgaaggtaggcgagacttggaaattgcccgattttttgtaatgtaacgcctcttaatccttgcgaagttccaggagcgaagcgaattgcgaaccacaatgtatggccgaaatctcgactacagtggtaaacaattatcttgtcgcgatctcgttgtacgtaatctgagagctgttggcgatagtacgaattacctatcaaaaggtttgcagtcgaagcattcgcaacgtcgtcgcctgacgcgaattctccggtcccgttaatgagggtaggcatgtctttgcggttcgtcagaaaaacggacgcgctcccacatttgggacagtaggagtcaagcgtgccgttgtaaaactcgattcggatgaagtcgcgccaggcagcgccatcgtcgtcatcccaaccttcgcgcatttcggcgctgagaatctgatacggcgctacctccaagaagaattcgcgcggcgtgggaattgaatttggttctttcgccattcgagaaaggactcccctgttacccggaatggaattccggattgtggacgtgggattacttgagcgcgagcacgacgttgttaacgagatcgagaatgaattcctctgtggtgtgttggttgatgcaaacgccgttcggatgggccgctatgttccgccgatcgagtttttcctttaggagtttgtgaaccgatactgaaattatcccggccgagcggcagacttgaagaacttcgtagtccttcaattccgcgaagtcgtctttcgtagagactgacgcgatgcgagcctttgggtaactcgtcgggagttgcaagttgaatttcgacaggtacgtgccatgcacgacggtacagacatgatcgaaggccagattccaggccatgacgatcgcggcgcgaaaggcgccgtgtttgaagcagatcaaggcttcgtcgagataggcgcggtcgtgttcctgggtgagcttggcaggtaattcggccaacaggttttgcacagcgatcgtcgttgggcgcttgctgtaggtggcgtctaatttagaaagtgtggttcgcgcaaggcagcagttgcctgacggcgagcgcagaagcaggttgttctggcacaactcggcgaagacgctgccgaaattcgccgggcgcggtagcctgactcgatcgaacctgtcgataatttgtgcttcggtgtaattgggtcgcttttcctgtcgatccatgaaccatgcaatggcaaggatttgttggctaatgccgaaaagttcaaacccttcgatactgtcgatgaattcgtcgagagtcatggaatcacgctcgccagggcgctttttctcggccgtacaccatcgcacacggtcccattgtccgttgttctatccggcgctgttcagtattcggactttccaagcaaatgtcgcaacgactttgcgagacgcccaacgagtatcggccaggttgcccgctgaatcacgtaaaccgggagtcattgaccctatgttccgcgagtggcggcgtgaatttcaggtggatttcaccggccgcgcgtcggcagcataattcggcgctcgcgatgattgttgcgacgtcgagcggtatggcaagtgtccggttcgctcgg

SEQ ID NO: 116 - DNA, 12077 bp, synthetic construct
  misc_feature 1..12077: note = Synthetic
  source 1..12077: mol_type = other DNA
ggcggcaaatcgatccgtgatttcatgaaaattttttgatccggttgccgacgaaagttcttccctgacgcatttgcgaagaggttcttcgtggctgcggggatctctgagccgcggcgatttttctcctctgatggcgagggcaatttcttcgccagtgatgggagagcccctactgaagatgattgccttttgcaccgtgttggcaagctccctcacgtttccgggccaggagtattgttccaaggttctctttgcatcatgcgtgagacctggattgtcgatgtgcatctccctggtgcatctcttgagaaaatactctgccagcatggggatgtcgccctttcgttcacgaaggggcggcagccatatggtgacgactttcagacgataatagaggtcggcgcgaaaacgcccttcctccaatgcctcttcgaggtcacgattcgtggccgcaatcatcctcacatccacaggaatatgtgagtgtcctcccagcctctcgatgctcttttcctgaaggagtcgaaggattttggcctggatggtaaacggcatatcccctatctcatcgagaaataccgtcccgccgtctgcctgctcgattttcccgaatttcctgtgggaagcgccggtaaacgcccctttttcgtacccgaatagttcactttcaagtaaagtctcgggtattgccacgcagttgatcacgagaaagggtttgtcttttcttgcgctgtggtggtagatggcgcgggcgacgagttctttaccagttcctgattcaccccggatgagaactgttgcgtccgtggaagctactcgtccaatggccttgtaaacttcctgcattgctctgcttttccccaccagggcgtcggcagaatcaatgtcttgcacggcatcgatctcaacacgagatcgcatcacgcggccggcctccagggcctttgagaccgtagccagcatctctggtatatcaaagggtttcaagacgtactcgaacgcgcccagcttggtggcctggatcgctgtctccgtcgtgccgtaggcagtcatgatgatcacgggaagttttggctgcttttcgtggatagccttgaaggtttgaaggccatccatgcccgggagacggacgtccatgatcactaagtccggctgctcagcggcgaccagcttgaggccgccctcccctgtcgcagcggtctgcacagcatgtccttccgcagacagcagcttggcgaaactgtttctcagttgcgcatcatcatcgactatgaggattttgcccactgatcaatccctctgatcggcaaggttatcacaaatcgagccccttgtcctgtcggagaatccagatggagactcccgccgtgctcttcaacgatacgcgctgctatgctcagtccaaggcctgtcccttcctctttggtgctaaagaagggctgaaacactctgtctcgaatctcctgcggtacgcctggtccgtcgtctgccacttcgatgcaaatgcgagacccgtcatcttccagggcgtaggacttttccgttatggtaataacgccgccgtcaaccagggcctcgcaggcgttggcgatcaaattgacgatgacttccttcaattgatctggatctcctctcgtctcgggcagcctttcctgacgaagcacctccaccttcacgtcgtaggattcgagcctatgcttcatcagtctgagtgctgcgtccacgaggtctgaggggcgtatcgcctgcattctcaggcgcggcgggcgagagaattccagaaagtttccgacgatggtgtctatgtgacggatttcttcggcaatgacttcaaaatcctctttttgactggcggtcagcgcaaggtccctttccattgaaaacaatctcatctttacagaggtcaacgggttcctcacgctgtgggcgacgccagcagccagcttccccacgagcgcccatttctcggcctgtgccaggtgttctcggctgcgctctagtttcgtcttggtctgatcgacgtcttctatgaggtcttgaaaacgaaggctgagaaccttgacttcgttctcttcctccatttccactttcttgttgtacgctgctgcagccagttcacggatggggccgagcacttccttgagcagtatataagctaaaatgctggcaaaggtgattgccaagcacaagccaaagagcgtcgccgcgttgctcaggccgacgcgatcgctgagccgttgtctcgcggcggcgatgctttggacaaaggcttctttgaacagccgacacgtcgccgcaatgccgttgaattgcgttcgcaagtcctgatggagtcggaatccctcttcttttcttccttctttgtaaagacggatgacctcgtcccgcgtgtcgcagtacattgcgtactgtgcgtacacgtctcggagcagccgtcgctcctcatcgtttgccgtccattgacgcgctttgcgcagccaactctcaaacgcaagatggtatttctccaactccttgagccaggcttcgtccccgtcttggaaataataggtgacatagcccttctgcatgaccaaggcattctccagctcctgggcggcttgcatggcttccaggtcagattcgatgaccgaagaaaaggtgcgatccatgatatacgaattgatcatggacatgagccctccgccgacggttatggacacgagcagggcaagcgctaccaggatgcgggttctgagactgagccttcgccacatggctgcatgattctcctttccagggtctttataccacgaggctaatgaggtgaacagcgggcagcgacaaaggaaacgacctaaacagtcgctttggccacaaaacaggaaaaggcggcagcccttgaggaatgttctcgaggtgaatcgcgaatttggacaaaagcttatttgcttgattcaggtcagctgagatggcttcgtcgccgacggctcctcacgctgacaaaaacgttcttgaagcgcccatgcgagcaaagccatatcgtgaaaaaaggtcaaaaaacctatattgacgaagcgatactatgtgaatgtacgtcaaaccataaaggggcattgcgaaatcttttttcaattgataatatatgacatccgcaagataatttctcaaaggaatgatacattgaaagtattgctcgtaagtcctgactaccctcagactttctggtcctttaatcgcgtcctgaaaatgacgggtaaaaaagctttggttccgcccttgggcctcataacggtcgccgcattgttgccttccgactggcgcctcgagctcgtggacatggtctttcagcgcatctccgactcgcagtgggacgcctgcgatatggttttcatctctggcatgggtgtgcaggcccagggcatcctcgaagtcaccagagaagccaagagaaggggcaagagggtcgtgataggcggaccatgggtattccactaccctgaggatgcctttgccgccggcgccgacatcgtggtgaagggggaagccgagaccgtcatcgatgaacttctcgcagccattgccgacgaggcgtcgggcaaaatcatttacagcgaggataagccagacctgcaaaggagtcctgcgccgcgtttcgacctcttggacatgaagagttacgcgaatatggcggtccagttttcccgtggttgtccttttcagtgcgaattttgcgacatcacgctcatgctggggagacgcgtccgcaccaaaaccccggaccagattctcgcagaacttcaaagtctctacgatcttggttggaggcgctgggtatttttcgtggacgacaacttcatcgggaacatcaccatggccaaagcactcctcaagagactcatcccgtggatggaggagcggaaaagaccttttggtttttacacgcaggcctcggtcaatatgggatcagacgagaccctgcttgaactcatgtacgcggccggttttttcagggtctttttgggcatagagacgcccgacgaagaaagcctcatcggggccaaaaaatttcagaatgtgaatactgatctggacaaggtttgtgagcgaattactcgagcaggatttcagataattgcaggcgccatcattggctttgacaacgaaaaacctggcgcgggagctcgactggttgaatttgctcgccggaaccgcattccagaacttttcacgagtctgcttcaggtcgggccaggcactgatctgtgcaagcgaatggaacgcgaaaagcggttggtgtcgttagactacaaatatctgagcaaccaaacgggactgatcaacttcgtgccgacgaggcctattagtgagatcgtcgaagaatacatgtatgtgtatcgcaccctgtacgagccaaaggagtatatcaagagggtctatgaatgcttcgagtcgatggatccgccgaagatcaagaagttctttcgcctgccatatctcaaggaattgcgcgcggtcctcatcaccacgctcagacaaggattgctttatccttcgagaaacgtcttttggaagtatttcttcaaggctttgtggaatttcccgagtagattcgatcgatatatcaccgcgtgcgtagaagccgagcactactttgatttccgtcaaacaatttatcgggaaatcgaatttcagatgcatagcatggacgaacaaaccaagagtcgctatgaggtagcccggtccctgtccccagtttcggggaggtagcccactgcgaccgagtccgagagctttttgctacaccgtgatcccgcgcatcatttctttggccgcgtgaatcaagccttgccaagagcacatcgctgggattgacaaacctcgctcctggcagtacctcaaagatatgttgactgaacgttttgactcttcaaacgtgcggagcgtatggtatcgagtctttttgcggtctttttttctcgaaaccttgtggaattaccaaaagatgcaaaatgtgggttttgtttttgccatttaccccgcgctcaaaagactctttgccggcggcgccgcgctccaggccgcagtgagccgaaatttggaattggtcaatacacacccttccatgggcccattgttgatggggctcacgctccttcttgagaaagagcgcgactgcgccgaagacgtcatcacatatcgccgcgccttcatgacagcccttgctgcgcaaggtgatcatatcttttggggcgtgctcaagcctctggcagccgcggtagggacagcgacgacgcttgtctctgggaacttctatgctggtccgttggcagcgcttttggcatacaatgttccgaacatggcagcccgcgtgtggggctttggcgcgggatggtctcgtggtttaagagtcctctctatttttcagtcgccgttttttcaccgtgcactttctttggcccgcgatgccacagcctgtggattagggagcgttgttggtgttataatatggtatatattttcggtagaatcgtcacgcgtccccatcgtcattcagatcgtggaggtgtgggctatcctgagcgctggcgcaggcggattcttcttgctctatcggcgagttccattaggcctggtgatgttcttggctgcatttggttcgctgtttttcttatcgtctatttgaatagggaatgatttgatatggcagacaatggcaatgtaattgaacgaactcttgtcgtaaacaaccctatgggcctccatgcacgcgtcgcgacaagtatggtgaaggccatggacaaatatgaatgccgcgtgacgctgcaaaaggattcagtggaggccgatgccaggagcgtgctgagccttttgctgctggcagcaacgccggggagtgaaatcgtggtgagggcggaaggtccggactcgttggccgcggtgtcagagatagataggctcattcaggaagaagaacaagtatcatctgaaatgtagcacaggaaaggtcggcctttgtctgattccgatgaacgatgcgaaaacgttatcctgaaggggatcggggtatccggcggcgttggaattggacaggctgtcatcatcgagcatcttaccaccgatatctgcccaaagaggatcatcaggccggaggatgtcccggccgagataaagcgcttcgaagacgcggtgcgatctgctgaggcgaggttgagagacataaggaatggtttggacaccaaccatccattgttcgatcacgcctacatattggagacccacattcttcttctccatgaccgcatgttttttgaggggacaaaagctgccattgctcatgagctggtaaacgccgagtgggccctcgctcaaatcatggtcagggtgacatccgcgttcgacaccatcgaggacgaataccttaaggagagagccagggacattcattttgtgggagagcgggtactcaaaatcttgatgggaattcagtccacgggtaccgtccagcacctgcctccgaattccattatcgttgcccatgatctttcgcccgcggataccgctcagatccaaaaagacaatgtgtttggatttgcaactgacatgggaggcaagacgtcccataccgccattatggcgcgctctctcaagatacctgcggtaactggtctcgagaaaatcagcaagatagcccaaaccggggacacggtcgtgatagatgggagcacaggggtagtgataataaaccccgatcctgaaacgatttaccgatatagagagcgagcagaggtctatcgcaagtatcaggattcactaatggccttcggccttcttccggccgtgaccagcgatggaaatcgctccgtccgcattaccgccaacatagagctggtggatgaaatatctttagcggttaaccatggcgccgagggcgtaggtctcttcaggacggagtatttgtttcttggccgttccgatttgccctctgaggatgagcaatacgttatctacaaacgtatagtcgaggccaatgcgccaaatcctgtgactatcaggacgcttgacgtaggcggagataaactctccgcacattttcgaatttcccacgaaaccaatccagcgatgggtctgagagcgatccggctgtgtctgagccgagtggaccttttcaagactcagttgagggcaatattgcgggctgcttcccatggaacatgtcgattgttgatacccatggtgtcgtgcataaaggagctcattgccacaaaagagatacttgctgaggcggcagacgagcttgcagccaatgatattcctcacgcgtctagaatcaagataggcgtgcttgtggaggttccctccgcggtcgccatcgcagaccttcttgcgagggaggtggatttcttcagcataggcacgaatgatctcattcagtacgccatggccatcgaccgagtgaacgagcaggtcaactatctttatgataccctgcatcctgcggtgctgaggctgatccgtcaggtcaccgtagcagcgcaggcaagaggcatcgaagtggcgatgtgcggggaaatggctggggatccggtcaatgttccaattctcatagggttgggcatcgatgagctctccatgaacgcgctagccatcccattggtgaaaaagctcgtgaggtccgtcaccgtcgaagagtgccttgaacttactcgccaagcctttgatatgcaggacgcggaatccatacgggctctgctcgaaaattggttgagagaccgattcccaggggattattttattgatcactcctgatgtgcgttcatgaaacaacaaggtcacataaagattatctgcaagaacaagaaggcccatttcaatttcgaactgggggatacgttcgaggcgggcatcgtcttactcggatcagaagtaaaatcgcttcgcttgggcaaagccaacctcacagattcctatgcgaagtttcggcaaggtgaattattcctcgtggatgcgcacatatccccctaccctcaagccaacagggagaatcacgatcctgaccgcgaccgcaaattgttgcttcacaagcgtgaattgaaacggctgcttggtaaagtgacggagaagggattttcgctggcgccgttgaaactctacttcaaagatggtaaagtaaaagttgaattggccttggcgcgaggcaaaaagctctttgataagcgagaggctataaagaaaaaagaccagcgccgcgagatggagaggctggcgaaattcaaacacagcggacgatgacgcggcgatcgtgtcgagcgtcgatcgcgcgcagaggcgggatgacctaaatctgagttgagctggaacaaagcctctcggtcgttgtctgtataagacggaataatgcacatcctttgaaagggggcgactaggtttcgacggggacagttgaggtcaaggttgcatgccgagcgctccggtgactcgttaaaccgccgggaataaatatactcgccgacaattacgagtacgctctagctgcgtaagctagcgtccctcagcctttctcctgcgggggttgagtgggcgacgggcagcaggatagccaatgctccgagcctgttggagcggcggcgaaacgcttagcaggctggtctgggaggaccttttccgagggggccgtaccggacgagaatcaaaactcggaataagcatgtagaagctttgcactgaaggtttccggacgcgggttcgattcccgccgcctccaccagtaatattaataaatattttcgaccctagcctctcaagaagccagactcaaaactgagtgggatatcttcttagtccgctacagatttctcataaattcctgttcaaccgacctccatttgggttacaatcgcagcgagctttcccattctttggccactgagaggcagtcgccatgataaccctcgcaatcgactatggagcctctaacataggaatagcactggttcgtaacaccgaggaaggaaatgaacctctctttgcgggaacaatcatcattgacgcaaagggcgtcaaagacctggctgaacctcgtgctgccatccgaagactgaggcgtaccaggaagacgaagatacggcgcctgagacaactcagcctagctctgaagaggcttggtttgggggaggaggtctcccgcatagtgcggttcgccaggagacgaggatacaagtctctttttgatgaccctgatgaagcgaagcaaacgaaagatgacgtctcaggctatcgttgcaccagagaagaattcttccatgagctagagcacgaattacaagcaatcatcattgacacagagcagtatcacagagccctttctgtgtgtgaacgagtcctcaaccgcagaggagagcggtacggtgaaatcagacccctcaaaattgacaatcgcggtaggagccgctgtgcgtgggagggctgcaacagagtcaccccgagacgccacaacgcgactgacgacgtagttcggcagcaactcgtaacctattttcaaagccctctcaggagggagccaggcaagctccccatgctcgaacaggcagttgtgaaactggacatcatatccaagaatctccggggttccaacgaagccaaatgcagaaacgcccttaacaagagagcaagaacaatcttgagaggtttgcaggctgcgttgccgatgcatgaggatgaaggtggcagcgataaagaaagctgggagtatgttgagaaaggagtagtcaaaatccttgaaaacgcgggtggcagaaaccgctactgcagagaacacagcaaagcatattgcgacagagttttggagggtaaaccatctgaattcaaaagctcaattcaggagtccgatataatctcccggcgtgaacagataatctttaacaagctgtggcgatacatcgaagcaaggctccttccgttggctccagaaggaatcgacagaattgtggtggagaggactgcattcgacctgcttgcaggaaaacaaaaaaagattcgggacgcgtccagcaagtcggtagagagtatctatcagtatggtccaaggtatggcttcacgagtgagaaggagatgctgcgcaaggaattcggcgggctctgcgcatactgcggcaaaccatctgagaccctcttggagcgggagcacatactgcctcggaggcttttctttttcgacagctacctcaatattctcccctcatgcccccaatgtaatgctgccaagggaacatctcttccgggagtgagttctctcagagttcacgaagacgcataccgcaactatgagagctacattaatgagttaaagagcaagcgacctcttcatttcctccataccgaaaaaaagggaatcctgaatctcatgcgagaccctgaaagggcatgggattgggaacgataccttcgtctcattgccaacaatttcgcctccatcgtccaaactcagcgcggtccgcgtccttttgcgcgatacctgtattcaaagctttcccggagacaggaaaagccgcctgaaattgctttcagaagtggtcgtcatactgcattgtacaggagcgttgcctatcctgacttcagcaaggcccaggaaaaagcaggcgaagacgggaacagtcatcctgtgaaccacgcactcgatgcgctcttgttggcgtccaagctgccgcgccccgagccactggaagcacgaggactcaaccacgccagtcttaaagcttgggcggatcaagttcgtgggaaagcagcgccggcgggagaggacggtatcccagtgattcctgcatacaagtgcttcgtaccgggttttgaagagacagatgctcatgggtatgtcacggttgagatggcgatgatgaactggaataaaaaggatactgcaacaacgaaacaggacccttacgggtggtctgaatccagacaacacccgacaaaaagagtttcagcgagaactctgttcgatgacttaagagaggaaaaaagcaagaagaatccatctgaacttatcaagcgcatttatcatcccgcattgcgctccgctgtcgagaaagcatatcaggagtcccacaaccgcatccaggcagcagaggctctgaaaaactggctcagagactctgtgaagaatagtctgcgcagctccagcttctctcgtcatccgagtgacatacgtcgaaggcaagacttggaaaggttcgccaatggcaagacagatgaaattcctgtggtaataggaattaaatgcctcgatacaggcgttgctggaaaaatagacgctgctcgtatggaccgtcaaaccgggaccacggggcaccgctacctgactgacccagccaacaggggcgtggtgcttgcttatccaacaacacggtctggcgcctgtgatagaagaaagccatgcacagctggcatcaggcaaaattattctctcaaaaccgatgagactgcgtttcggtcaatgccagcgtcattggaacgaggcgtggtctggggcaagaaaacacattctcccagagccatggagtcagcgttcagcaaagaattggagcagtatcttcgcgaccgtcgctttcacagttactgcattctcacagccggatgtgtggtctgctatgaggacggcacagagagattcataaggaactttgacaagagcaagggcttcaagaagacaatcctcaggaacatagtcgcgctgaagcggactccgctctcaacgcgtgttgtacctctaaaagtgttgacagcactgccgtaatgagaatagaaatagaaaagacactcgttctttgacaaatcgttcgatatgttcagctccggttgaaaagagcatccgtctggtagccatgcactccggaatggggcagttccggctcttgcgacttagtgggtgaaagctcattgagccaactacgagacacgtctctacgagacaggatgtgagcccttatttatcatgatttcaagctgaattttccgcagtcgttgcgactacgtgtttgggggatatactggttcctcatacctagtttcaatcaagctgaattttccgcagtcgttgc

SEQ ID NO: 117 - DNA, 2657 bp, synthetic construct
  misc_feature 1..2657: note = Synthetic
  source 1..2657: mol_type = other DNA
cgatatttaaaaagcgggccacgttgaccaaagaaaagagcaggtctcccagctcctcttcccagttgaccgtggccgtcccgctcagggcctggcgcagttcctgccattcctcctccaccttatccagcgccccttgtaggtgcggccagtcaaagcccaggcgcgccgcggcctcccccacccgttgggcctggaccagggccggcatggccttggacactttccccagggaagcgggctcgcccgttttgccttccctaactttggcctgctgccagagctgccgcaactcctcctgggtctcggccttttccccggcaaacacatgagggtgacggtgaatcatcttggcgccgatcccggccgccacctcggcaaaggaaaaatagccccgctcctggtacaggtcgcttaaaaacaccaggtgcaaaagcaggtcccccaactcctccttgatcttgtcggggtcgccgctatctaaagcttcgatcagttcataggcttcttccagcacataggtcttcagagtttccggggtctggcgggcgtcccagggacaacccccggggcctcgcaagcgccggacaatcgcgataaaggcggccatagccgccccgggatcatcgtctttatcgggcatagaaaataaactcctaataattattcggacgtgcggaaagggccgggtaagcaggggccgggtcacccccccaccccctcacatccccttagttaatgtagggcgggcattgcccgccattttcttgtctctcaagcttttcgtttctcctgggttttctgccactggcggaggtaatcgttcaaccgctgtttaaagtccgggggcagcagtcccagggtctgccgggagaggtgcatgaggtacggaacagcccgggattctctgaacaggcgggagtctcgaggcaggaccacgcccagaagcatcgaggcgaagcctattagcaaggcccccttgaccagggcaaaaaacgcccccaggagccggtcaaagaaatccagatacagatgatacaacaggcgttggagaaaatgggccagcacccgggtaacccagtaaacggccaccagcgccaacgcaaaggccaggaggcgggcgtagaggggctctttgatccagggcccaaaccggtccgccaggcgcaggtaggtgtgggaggccaccaccacccctcccaccaggcccaccaggaccgccagttcctggaacagtccccgatagtaaccccttaagctgatcaggcccagtaagaccacaatccccaggtctaataaattcatgcgcgccgccttttatacctgacacccctatcaaaaaaacccgcacccgtcaagcaattggccaaggtaggaacactacgcaagagttctccccccgaaaactccccttcttttcttgaataacaaatttattgctggtatcttaaacacagaataaacgatttgggtactcaacttgaggtgcccatggcttccaccttcaccctcgccatcgactttggatcaaagaacatcggcctagctttggtccacaatcagaaccgcgtcaatatccccctgttcgcaggcaccgccctttacgatcggttccatttgagtaaaaaggtggaacctcgagtccagatgcgccgaatccgccgcaccaagaagaccaagcaggcaaggttgaggcgccttgaggccgggttgctctcgctgggcctggagcgggaattggtgggctggttgatcaatttctgtaggcggcggggatacaagtctctctttgacgagggaagagagcccagacgcgagaaaactgaggaagacgccgaggttttccggttctctcgcgaagagttcttcaagaccctggagaacgaactgccggcgcgccttcctgaggatcaattattcccggtgctgcacttatgtgagcatgtgctgaatcgcgatggtgaccgctttaaagaggagcgcctgatccgcattgataaccgcggcgcgtctcgctgtgcctgggacggctgtagccgcgtcacccccaggcgggacaacgccctgcgcgatgtcctggcccagttcgtattcacggtatacgcccaggacgtgcgcggcaacccggacctccaaaagaaggtcgagaggatgcttgatagggttgccgaactgggaaagcgcttccgccacgcgagcggcccccaccccgaagtggaacgcaaggttctgcgcaaggccctgggggaagagctgaagctcctcaaaggcttgtccggcctggcccacgacctgcccgaagaggagattgcccccagggaggcctggacttacatccggcgcaacctgatgaacctcatcgaacagagcggcgggcgcaaccgcttctgccgcccgcacagcgcccagtatgtctcacacctcttggcaggccaggttattcccttcaagcgttcactgacggaaagggacatgacctccaggcgcgaggagatcttgttccagaagctgtggcgctacctcgaggcgcgtgtcctgccgctggctccgggcggaattgatcgcgtggtggtggagcggaccgcctttgatctgctggccggaaccagaaagcagcgccaggaagtcgccgacaaggattacctggaggagatgta

SEQ ID NO: 118 - DNA, 22829 bp, synthetic construct
  misc_feature 1..22829: note = Synthetic
  source 1..22829: mol_type = other DNA
atctgggagttatagtaatagaggagaaggcaaagcacccccgtaaggatcaaggcaagagcgatcagtttccctttggttcggagcgagaatcccatagaaatgaagaaaggtcgtctgagctgcaaactttcaaagaatcttccaagctttcaataacataaattgtccgcagagtaaaggttgggggcaaaccccacctccaaaaaataccgtgcctcccggtttaaaatgagggattcacccctgtgataccgcctaacgtatcatggcaaacccaatgaccagaacacccaagatcaatcggtaccagacgaatggtaagaaatccttggtctgaacataccggagcaaaaagccgatactggcaatgccggttacgcaagatgcgaacatacctaccataacgctaaaggagactaaagatgaatttgaaatgacgtgcggcagtttaagcacggcagcgccaaggataatgggagttgatagtaagaacgaaaacctgactgcgccctcgcccgttacccccatcaacaatgccgtgctcatcgtaatgcccgagcgggaaactcctggaataatcgccaccgcttgtgatactccaatcaataagctggaccgaaaggtgatctgggtaatatcaatattcttggcgcttctccggtctgcccagtacagaagaatgcccatcaatatgagcatgatggcgattagagtaggcgatctgaatatcgtttcagcttttttttccaggaggaatcccccaattgctcctggcacactggcagcgacaagataccaaaacaatctaccctccgtgctccggagatcagtaaagcccttgataatgagtcgccgccagtccttccagaaatagatgaccacggcaaccagtgtgccaacatgcaaggcaacgtcgaacgtaagtcctggatctgcccacccgaaaagccacgggaccaagaccaaatgtgctgagcttgagatgggcaaaaactctcctaaaccttgaaccagtccgagtatcgctgcctgtaatagagtcaacttctgccctccccatgatcacacgcaaaaaacccgaaaagaaaagccctgacggatgtcagggcccagtaacagaactggtgtccccaaccggattcgaaccggtgttgccggcgtgaaaggccagtgtccttggccaggctagacgatggggacaaatcaaaacggaataatggaatattggaatgatggaataatgggttaacagaaactctaacccattactccagtactccatttctccagtgctccaatcgtttccttatggtgggccgtactggactcgaaccagcgactctctgcttaaaaggcagatactctacctcctgagttaacggcccgatgataattaaatagaataaagggaagaggctgaattgtcaaggaaaaactgagattttcggtgacccttcgacgactgacaaaaagaggtccgtctctcacgggggtcgtaaagaacactgaggaagtaatttaaatcttactttcgacaatctcggcgaactctgccggagatagatctgatctcagcagttcaggaaaggattctgaactcctatcgtttcgtttctttccgaccctactgaaaccatcgtgatcctggttcgggtgagctcttcaatcctcttcaagtagcgttgtgcatttcccggaagatcggaaagattctttacctcccttatttcggttctccatcccggcaattcctcatagaccggctgcgaaccatttagtttctccaggttcgatgggacatggtagaaggtctcaccgcccaatcgatatcccacacaaatcttaatcgtatcgaattcgttcaagacatcgagcttagtgattaccaatccgtgcaggccgttgatccggatcgcatggtttacgatgactgcatcaaaccagccgcacctgcgcggcctccctgtggtcgccccgtattctccgcctttttgacgtatcttctccccctcttcatctctaagttctgtcgggaacggtccctctcctactcgggtggtataggccttggccacccccaacaccgaaccgatgagcgtcgggccgattccagagcctgcacacgcattcccggctaccgtattggaagacgtcacatagggataggtgccataatcaacatctaataaagcgccctgagcgccttcgaagaggacatgctttcccttctggatctcctcgtggaggaagatcgaagtatctttcacatatctttcaagctgcctcttgtaggccatgtactcatcataaatcgctgaagcctcgaaaccctcttccttcaagatttggaccagatagaggttcttctgtttgaggttttcctccagcttcttccgaaacaccttctcatccaaaagatccaccattcgaatgccgcagcgagccaccttgtcctcataggccggcccgattccccggcccgtggtcccgattttgaagaccttttctcgagccacatcgatcctccgatggtagggaaggatcaggtgagcctgctcgctgatcaggagctgggagtcatccttgaaatagcctctttttttaacgtcattcatctcttggatgagcacggccggatctaatacaaccccattcccgataatacatctcttgttctgatacaggatgcccgaaggcatgatgtgaaagacgaacttctcatcgctaatcaagacggtatgaccggcattattgccgccatgaaatcgtaccaccacatccgtatactgggttaaaagatcaacgatctttcccttaccctcatccccccactgagctcctacaatcacgataccagacatttaaaatgaaccctccgtgtttcctgtcaatcatttcttcggccatccgccaggcatgagaaatggccgctcattagaggtgaacctgacgaacagagatgatattgggcagcttcaggatctcatcagccattccaggcgataagggactatccaggtgaagcagagaggtggcattgcctccctttcggttgcggaagaactgcatcgtcgctatattgatattctggctcccgagagtccttccaatattcccaatcacccccggtttgtcataattgttcaccagcacgatgtgcccttccgggacggcttctataaaaagatcgttgagcctgacgacccgaagctcctttcgtccgaagagggtccccgcaatatagttctcttccgagttcgctcgggccgtaatgccgatcaaacttgcgaaatcttcagccttctcgctggtggactctacgattcttatccctctttcctgagccacaatcggggcattgacaaagttgaccgtttcacccacaaagggagtaaggagtcctttcaggatggagtttttgatcggttttgtcccgtattcgatcacttcgccctgatactcgatcacgacttcttcaatggcatagttcgagatctgtcccagaaagctccccaacttctctcccagccggaggtaaggtcgcagcagcggcaaaatctcagggctcaccagtggaatgttgaccgcattcggggcttctcccaacgttaggtaatccacgatcttctgggcaatggcaatggccacattctcctgggcctctcccgtcgaagccccaagatggggggtacaaataacctcatctaattcaaagagcggattgggaccggccggctctttttcgaaaacatccaatgctgcccctgcaacccttccctccttgatcgcatcgtaaagatccttctcgttgatgatcccaccccgtgcgcaattgatgacgatcacgccctttttggtcttcgcaaacgcgttcttatcgatcagataccgggtctcatcattgagcggggtatgaactgtgatgtaatcggcacggctcaggagctcatcgaacgaaaccaactccactccttttttctccgctgcctccttggagagatagggatcgtaaccgatcaccttcatcttcatgcccctcgcccggtcggcaacgatcgtcccgatcacaccgataccgacgagcccaagggtcttggtataaagctctacccccatgaacttctttttctcccacttgccccccctcatggaggcggtcgcctgggggatctttcgtgagatcgcaagcatcatggccatcgtatgttcggcagcggcaatggcattctcctgaggcgtattcatcacgacaatgcccttcttggttgctgcggggagatccacgttatccagtccaatccctgccctaccgatcactttcagccggtcggccgcctcaatgatatcggccttcaattttgtctcactcctgacgatgatcgcatcatactccggaatgatcttcttgagctcctccggaggaaggcccgtcttgatgtcatatttcacattctcggcccgcccaagaatctccagtcccttgttcgatagaggatcactgatcagtattttcgtcatcttttccattctcaactccgtttgggttcattgggtcattaggttcatcgagttatagggttataaggttattgagtcaaaacccgagcaacccgagcaactcaagtaacccaagtaacctatttcatgaggacctcctccgctgccttcactccctttcccagttcaaacggataacccatctcctttaagagcatttcgagggctgagatcaccaccaccatatccaacctctcataatagcccaggtgagcaatccgaataatcttgccttttgcccggtcctggccttctgcaaccgtaattccgaacttctcaaagaagagattccttaatttttccccgtcaataccctccggaatcttgacggcggtgagggcgttactgggtgaatggggcgcatagagttcaaggccgatggctctcactgctgcacgggtagcttcggccaatctctcgtgccgacgaaagacagcttccagaccctcctgccgaatcatacggagggattccctcaaaccgacgaagagggaaatcgccggtgtgtaggcactctggttttttttcgaagacttcaattccttcttgaagtcaaaatagtatttcggcagattcgaccgttctgcaaacttccaggccttatcagagagcgcagcaaaagcaagcccggggggaagcatcagcgccttctgggaaccgctgaccacgacatcgaccccccattcgtccatggggatgctgaatacgccgatccctgtaatcgcatccacaacgatcaccgtattctcaaatctcttaacaatctcggcgatctctcgaatgggatgctttacacctgtcgacgtctcgctcgcctgggtatagacagcccggatggtcggatccgatccgaggatctccgcgatccgtttcacatccacggcccgaccccattctacatcgatgggaataaactcaactccataggccttacagatctctccccaccgttccccgaacttgcctccccggacaacgatcgccttatcccctttcgataggagattacttacagatccctccattgcgcccgttccggaggaggtgaaaaccaggacctcgttctttgtctggaaaaggtactttaagccctcccggatctcctcgaaaaccctctcaaattccggttcccggtggtgcatgatcggttccgccatcttcagaagaacttctggtggcaacatcgtcggaccgggcgaaaacagatactttttttccatggctactcccccattcgaaatttaagagcctttcaatattattgtataagacgttctatgtcaacactttttatggggggttcgaatgcctcggttttgggtattcgattgcgatgcgaacgggcaggggcgacttgggtcgcccttcagcaggcccccggtaaaaccgggaccccaccctatgtgaccccgtaaatctaaggcatgacttctttctcttcaaatttcttgactttttaaggattattttctaatttggaattgaaatggtacgggtggatgagccgtggaaccgatggtgacaaaaacactcgctgagatctatttaaagcaaggccatcttcgagaagcctatcagattctcaaggccctctcggaaaaagacccgttcaaccaggaagttcaagagaggttaaaagaggtgagcgagcgccttggcctctcgaatcatccggagccggtagaggcttcctctgttctgtcagaagaagagagaattcgcatccttcaaaagtggctctccaacattcaagagcaaaggaaaaaataatgtcccctatccttcacgaaacaagacgggcatctgttcgggcaatactccgatctcgtaacctcgatgccatcattttcagtagccttgaaaatatccggtatctctgcggtttcaccggaagtgatggtgctctcgtcctcacgccgggagagtctttcttcctctgcgattcccggtattggacacaggcagagcaggaggtcaaggaatcccggatcgttcactacaagaaaaaaatagaaggcatcgcaactctcctgctggagttcgatcggaagcatatcgggtttgaatccacctctctcactttctcgttttatcaatctttgggagggagacttgcaggtcagggagagctcatccctctggaagaggagataaagggattgagggttttaaaggatgctcaggaactgtctcttatgaaagcagcgatcgatatctccacaaaggcccttcggcatatcctcgacctgatgagggaaggcgctgtggaaagcgaagtcgcctttgaaatggagtgtttcatgaaaaagaagggagccgatgccgtagcctttgacaccattatcgcctccgggaagcggtcagcccttccccatggaaaggcgagcacaaagcgaatcgagaagggggatctcctcctcgtcgattttggctccaggtttcagggctaccattctgatgaaacatgcactgccgtcttgggccagccttctcccgaacagaagagggttcatcaggtcgtcaaggatgcccacgacaaggcgatcgagggggttcgaccgggaatcccgatcaacgaagtggacgcgattgcaagaaattacatcaggggttgtggatacggggactattttggccatggattaggtcatggtgtagggcttgcggtccatgaagaacccggtgtaaacggggagaataaaggggttgtcgaggagggaatggtttttacaattgagcccgggatctacattcctgactgggggggagtccgattggaagacatggtcctggtcactgccggcggggctgagatcctgacctatcttcccaaggagctgatcgtgctgtgaaaaggctgcccctgcccttgacaactccggtccttttctattatttttgttgttgttctttctggtttgattctttctccaaagcgggcatagctcagctggtagagcatcggcttcccaagccgagggtcgcgggttcaaatcccgttgcccgctccatataacctattgaaaattcaataattttcaagatattccctcctgaaaagccaaccatttaagaccccgattgtgactgatttgtgactggacttttccccatttccttcttgtccaactttagaacggcgtccctcaaattctctggagccagatgcgcatacctctgagtcatcctgctatccttatgtccaagtagcctttggaccgtatacagatccactccattttgaatcaacgcggatgcatagcagtgacggagatcatgaaatctgaagttctctattccagccgttctcaaggccttctggaatgctctcttaatttccacatatcgttttccatcggttctacaaaagacataggatgacctgatgtgcctcaccttggagagtcttttgaaaagctccagaagcgtatcgttgatcgggatttcaagcctctcattatttttggtgtgttcgaggaggatgacctttcgaaacaaatcaacttgttcccattccaaggacaagatattttctcttctcatgcccgtgtgtctggccgtcattacaattggctttagccaatcagagcaggcattgtgaagctcttcaaattcttcatcgctgagatacctcacccttcccggaggttccttctctaacctcaccgctttgacaaagttttcctttaacagcctccattctccacaggccattgaaaaagcatgtttcaacaaaaccagttctcggttgattgtccctggagaggcaccttcttcccatctcttctgcttgtatgaactgactttgtcggttgtgatgtcgggcaagacgtaatcccctaaatatggtagcagatgtccgagactacttttgtccctaatgtgctgctttggtgattttttaggagaatgctcgttcatataccttgccatcaattctttaaaactcaaagtttccccgggtagcttatcaaaccacttgccttccgcgatcttcccccctattttgtcatgaattctttgggccagctttttaccagtcgtttcagttgatcgtctaatccgtttccctttgacaataaaactcatccaccaaaccgagcctctcttataaagacccatcggatacctcctttctgaggcccttgaggtccggtttcccgttgcccttaccgtaatctttcctcttcccttcgtcaatagcctttcgaatgatagcgtcaacgcctgtctttccatttccagagattgactttatgatctccttcgccctcttttgcggatcaacaggctccaccttgtttgatcgcagccattcttcgatttcagtgatcttaaaccggatgagcctgccaagtcggtgatgggggatctcttttgcttcgaccctggaatatgaaggtagatttctttacggcgagatactctgacaattcttcgaggctgtaaaactcctttgccatatggcgcacctgtccccttccgcaggagaagggaacatttgtcgcctcatgggcaacttcgccacttcgttctgcacaaaagattactttgctccaaatctacaaagcaaccgcgcccttggttaccgaggggacctcggcttgagggaaccctcagcccgtggggtcaacggcatattcagttgtcaaagagcgacgcgagatgaagggaatgggaaaaagtgggatcagagggacccccacaaaatccatgcccttgaatcttggctcatctcattttgatttcattcaggcggacaaaaagcggattgtccaggatatcatctcatagaaggtaggataaactaattttatccaaagaaagattttttgtcaagcaactttttttacgttcaaaccaacccctcccctatcctgggctccacgccctccctcttttgggtcttctccaaaagtcctacccctgaaccttttgggccttcacgccagtattctcccaaaccctaaaattcatcttttaaggcccctctgtgccggagggcaattgatttataggccaggggggaaagagcgcttataaattcgttttagagggtttttaaactggaaaacaagggatataactggcggaaattgctgctaatttgccaggagggggattatgggagatatggtggtgtgaattcttccttttcccccggcaatcctgctttctgggattggcgattctccgggatcaccttatcgacaatcttaccgcaagtgatgcatctccatgccggaaaggttcattggcagagtagaaatccatatcggaggaaatccttgatgcttttcggaaggagggctcgaccggctccacataatttttctattgaccggacaccgaaaaatgcgtagaattcaaccatccggctgattgctaaccgtcttctctcgggaagaattacaggagtctttttaggaaagacttcacaatgattacactcggaatagattacggctcatccaatatcggtatcgcactggtgaggaacaccggcgagggcaatgagcctttattcgccggaacgatcaaaatcgatgcgagaaggctgagggataaggttgaaacccgtgctggcatccgacggttgagaagaacgaggaagacgaagagacatcgtcttcggaatcttcggaacaggttcctgtcgctcggaataaaagaagaagatgttaacctgatagtcggcttctgcaaaagaaggggctacaagtcgctcttcgatgatggggaaaccgtagaatccgaaaaaggagataatcaactcacgtatcggtttacgagagaggagttttttagaaatctcacggatgaactcaagaccattcttcctgattcttcgcaatttcaagatgcccttaatgcctgtgaaaagatactaaatcgccgtggtgatcccttccaggaaatccgattgataaggatcgacaacaggggggcaagtcgttgtgcctgggaaggttgcgacaaagtgactccccggagggataatgcccttggcgaccctatcgcccaatcgctgcttaatgcggttcaggaaaatcttaaaggtgaacctgcccgaatggggacaattgaaacggatatatcggaactggatactcttggaaggcgtatccgggccgcttcaggagaaggagccaaagaggagaaaaaggctctgcgtaagaatgcccgaaaggttttgagggaaatcaaggctgactttttcaagcccgacgtggatgaagaagaacgggatagggcctggaagtatatcgaagcagggatcttgaacatcatggaaaatagcggtgggagaaaccgctactgccgggaacacagtaaagcctatatccagacagtcctttccgggaaggcggccccatttaagagaaccatctctgattcggatatcatctctcgcagggagcaaatagtataccagaaaatctggcggtatcttgaggcgagagtgtttcctcttgcacctgaaggaattgacaggattgtggtggagcggacagcctttgacctcttggcgggcagcagaaagaatatccaaaacgcttccgatcaattcgtggaggagatgtatcagcatggacctatgcatgggttttcaagcactgccgaaatgttgaaagaagaatttgccgggatgtgtgcgtattgcgggtgcgaatcggctgcccttatcgatagggaccacatccttccacgggcggattttttcttcgacagttatctcaatattgttccggcgtgtccgaaatgtaattctgacctaaaggggaagcggccaatttcaacttcccttctgcgcatcgatgataaggcatatgaagcctactcccattaccttcagaagatctctaaaagtcggccaatgcacctcttccatacgattaaaaaaggggtgctaaatctcatgcgtgaccccgaaagatcttgggaggtggaacgttacctttccctgatagcgaaacagttttccgagattgtgcaaacccagagaagcccccggcctttcgctcgatacctcacgtcaaaactcattaaacgtcaagagaagatgccagaaattctattccgaagtggtcggcacatcaatctttatcggaccatttcctacccggctttcagcaaagtcgaggaaaaagaagagggaaatacggcgaaccatgccattgatgctatgctgctcgcttcagaccttccgagtcccagtcccctggaagccctgagtatccccgtatctctcgtcaagagatggtctctctcggtgcaggagagtgcgcctaaaaccggaaggaatggaattccggagattccttgtcacggttcttatgtggacgggtttgagaaggtggatggaaatgggtatgtggaaattgaactggataagatgtcttggaaccagaaggaccgtatgactcacaagcaggacccttatgggtggtcacaaaaagcacaaatgccgacgaaaagaaccgccgcagtcgatctctataactcgctgaagaaggaatccaatgtccaaaaggtaaaaaatataattgagcggattcatcatccggctctgaaaagggttatggcggcatccgcaaacagtgaaaacccaggtggctctgtggcagagaccatgaaaaagtggctccgccagtccgtgcaaaacagtataaataattcttcgttctcgaatcacccaggagatcaggcccggaaaggggacctcgaaaaattcacaagcgaagaaaccgctatcccggcagtcatcggcataaaaatgtttgatacgggcgtaagggggaaaattgatctgtcaaggatagataaacaaaccgggaaggtaggccaccgctatatgacacagcctgcgaatcggggagtcattctggcatacccaaagaaaccatcgggagaaccagacacagataggccctacctggctttcattaaacaagattcctccttgaaaccagagggggctatgtttaagcctttaccagagggaatccttaatgggaaaatccttgggacgggctactcccccggcgaatggatgggtcaggtcgagaattatttgtctgaatgcggtttccacagttacgtatcgttgacaccgggctgcgtagtttgctacaaaaatgggaaaaaatggttcgtcaggaattttgaccagagtgcggattttaagaaggcaaggcttaaggacgttgcagggatacaaagaacacccttcataactcgcatttctccattaaaaatgttgacataactaaacctttggtgataaaagataaataatacctgttctttgacaattcatgaatgtaaatcagttccggttgaaaagagcatccgtctgaagggcactccgggatagggcagtcccggctcttgctgtttccctggcacatcactgtgctccggaaatgaaccctcggacaagtcgaaagacaggatgtgagcctaatttatttctgcaatcataactgatttcttgcagtcacttgcgacttaggcatcccctatacggagtaggaccccggagtttcaatcaaactgatttcttgcagtcacttgcgacggtaggagataccccccctgagttggcgctcaggtttcaatcaaactgatttcttgcagtcacttgcgacgtgcattggtgccgcttctcaacgtaaccacgttgtttcaatcaaactgatttcttgcagtcacttgcgacttattctgcaaagtgtcctcattgcggtgtaaagtttcaatcaaactgatttcttgcagtcacttgcgactgcccgtgaaattgatctgtattccgtagagtatgtttcaatcaaactgatttcttgcagtcacttgcgactgtcaccatgaattgtcaaagggcagccataacttacgctcccgtttccgcgaacctcggatttcatgtctgattttgacatctgaaatcacctggttcgcggttgagggtgcaggtgtggatgggactcattaatgtccaaagatgttgaatgagttgataatccaggggggggatatgccaatgttttgacggtccctcccaatgtgaagcatgaggagagattccgaaaggcgtaccgggaggcgagagaagagacgagcgggttgtggaggtgagggggggcggagcctttctctctgaagttttcgattacccaatcgtcattatggggaggtgaagcaagcttgacgggaggacctatgacaatctgaagccgtagaggaggttacctaccgaaaaacttggcaccgacacagaaacttcttgacaacattgacggaaaagtgtagatttttctaaattaatcgttttcagattatctccaaagatgtaggtcgctttttggatattgagggatcttagactttattcggattgacttatgaaaacctacgtagttacctttgaaagccattcggatgcctctcgggaaaaagtagcggagcgtcttaaaacctatggttactactgcccaatacataactactgctgggcaattatgacggaaaaaaccgctatggagattgtcacctaccttaaggaagttataaattccggtgaacgactcttcgttgttaggtccggcacagaaggggcatgggtcaatatctacggcgaaaaaaatagcgaatggcttaaaaagaacctatgactggaaatcttcccagtgaacaaagcggtcaaacgggaccccgcattcgtcatggtcgagttgaatcgattgatctttacgaaatcaaagacagtgaactcgacttactcgaaaaaggctcaccggcgagcattcaactcaatttctcgatttttctgttgtcaatcgccttcacaagcgttggctgtcttgctaccgcaacctttacaaaccagaccgtcaagactgtcttcgtattcatcggggttattgggattatcatgggagcatacctcttgatcttatgggctcgcacgcgctcttcaataagaggggtcgttaaaaccatcagaaaccggatacctatagaaccttgtccccaacctcctgggacattgcccaaaagttccgaaactggcgagggagacaatgagcctgtggggtagatggcaaattgcccggaagaattggagcgtgttttaactccaatgtcacgggcgcggacgacttcaaggggggctcttacgctcggcagggtgatgttggtcacggtttctcgcatcggttctcctcctcgtctcttcggataaccgatgataacaccgcgcccaacagatttcaggcaagcttaccgaaaggacacaatgtatctcgatgtagattgcagacaaccacgacacattctccaaaatctgaggtttaaccccgctcgaatccccgcccaatgaaaaataatatggacttcgaaaagtatcatggtttaaccgcataatatcaccattaaaacactatccaggatggtcaggtcaccccttcttccccttgtctttcttcttctttccgacttccacaatttgccatttaagttcatgaccgacaagcctaagaaggctttggattctttcgagggcattgtcacatcttcgaatcctctcgtaaagattcgtcccttgtagcttattcctgctggctatcccgtaaaccccacccttcttccgaaagatatcaagaatcttctccgatatggtcgatattcgagagcgtttcggtttcccttttggcttcttcatggggactccattccatgagggggatttgtgtatggaattatgatatattattttatggagaaagtcaaaagggatggtcccttcgaatctgactcctcaagacctgtctcaattggttactcatatcaacccttccttttgggctttctttatgaatagccgccagacaaatccctcggcatgggcttcgctctggaaatatgattcgggagtgattaaatcatgcgggtcgatttccagcatttgctgaatgataggcttgaattccggccttaccaccgcttcgatttccttaacatagttttcgtaattcatagtgaatgttatggcagtggttttcatttttgcttagcacctccggtctttcttcataaatgattccgtccaggaatcgccctcctttctctttatccctcccgcccatctgcttgaaaaagaaagggatttttgccgataggcattggtcccttatctccaaggcccattctggttgcatgggcctcgctcgttttccggattcgccacccacgattacccaatggattccttcaaggtcaaggttcggaatgggtcctaagaggggttcaaaagaaatgaatttggtaacggcatgggtctttctaaggtcgtcgattcgggaaaggtagtccgaatcttcaaccgttactcccatcaggatatggggaccccaccttaatcggggatcgagcttcagaagttgctctgacctcttggttaagatttgataaaaatgccagtcggcccggtgcatggtatcgaatacctggaagataaaatcgtcagggacctcctcatgaaagagatcgctcatggagttaacgaaaatggtccgagggcttttccacttcaaggggagatccacaaggttttcatggatggtgagtcttgacccgttttgatagctcggaagacccattgcctttagccgttctgcaagaggaagggcataacaattcagacatccgaggctgaccctcgaacatcctgtcaccgggttccaggttgaatcggtccatgctatctttgacctcttccccacttatcttcacctctttcctttcccctattttaccaaatccggagtccattttcaacataaaattaagcaatatcgaggacttgcatgattcttaggggtttgccaagaagaaaggtaatcgagatttgacaaggcacctgaaaaggagtagagtacttcctgaagtcgtgatctctaaagtaatcctgcgattcaatatttcaatcgatattgtttaagagaaaacttttcacaagctcatttttggtattgacataattatcacttttgatatcattaattcaccgatccgaatagaactttccgtttccaaggagggtggtagatggagaaagaccttcagaatttccatttggagatcttgagttcccacgaaaaatgtaacccctatttccacctggcctctaagcatattttaagggccttccgcaagtaaatatgcttgcaaaattagccccgatgaagccgaaccccgcgtgagggagggttgaaaaaacgaagtcgatacaaaatgtggcaaaaatcgggtctccatccaattagggcggatgggaggggttggaccgagtacgaaatggatcttttttgttccggcgggttcccttgaaggaggtggtgagagaaaagccaaaacgattaaaaaggaggtgatgcaacagtaagaggcgtttcggcatgtttgaacgtgaagtcgtggctgtattcaaacaaggtggacatctatgaaatgtcttgcaatgcagccgtaagaagggctgcaagcagaggagggaatgacgatgagtataagaaaatatgggcaaagcttaatcctggcaatggcagtagtctgtgcgatcatgcttggcaccgtctcaccaagcgcagcgctttcccccgtgtggggttattcctacgagcagttggcagccgagtggtggaaatgggcactttcaatcccggggtacgtgagcccgctatatgacgaaactggtgaatactgtggcgtggggcagcacggtgatgtgtggttcctggcgaactggtgggacgattcggttacacgtgactgctctgtacctcaaggcatgccgctctttttcccggtcgtaaactctatgtactttaacgcgccgcctaccttgtgcgaaggtagttttactgtcgcggcgatgcgcgcttacaacgcttcgaacgttaatcaggcattcaacaaatcggcctcattggatgggaaaccgctcaggatgcaacgcgaacagtccgtagtctttgcggtcaattttcttatttatggtgacgacccctattgtccggcaggcatatattcccctgccgtagatgatggctattatgtgttcctcagcccgttgacaccaggcacacacacactgaacattcacgcggagtttccggggccctgggtccaggacatcacgtataccctgactgttgtgccagtcatactgaaataaggggaagcagggcggtgacttcggtcaccccccttttgttcaatccatcagtcagagttttgacgcgcacacatttaacaatggttacggtttctgctatagatgtcctgttttcaggcaccgagaatgtttcgatatgattttcaactattcaattgaaattcctgattttcaaccgtaatcgttgaaccccagaatcgttccaaagcaagacttgtaggtgtactcgttaatcaagacttgatttgatattgtctttagaactaaatactgttcaggacgatttaaccgctgatggtgaagatgggacggccctggcgtcccatcggtcgggccttctcccatcgggtggttcttatcttcttctcatctttttccgaagcatggctatgaggaggactatgccaagcaggggggattttcctcctccattggggtcatccatatcgtcttcaatccgcttgaggaagttcttcagatcttcatcggcagggaacttctccagacctttttgaagaacttgtcttgcttcctgacgccagccaatttcgtaaaatgctactgctgcgttgtaatacaggatcgaatcttgatccgggaagattctgagcccttcgaccgcaacttcgacggcttctttctgcatccggaatcccagatacgcacagcagagtccactgaaaatacagagacccggatacaccgttgggttacgcttccagatctccatggctttctgataagaccgaagtgcatcctccatataccctgtctctaacgcacaatatccccgccctgaaagataccttgggtcttcggggtatttctcgacaagatcttgcatgatttcgagtgcgtcttgatgagaccccaattgcatcaaaacatgggcttcattgaaaagcataactggattatccggggcaaacctgagcgcagtctcgtaacatttcaacgcttcaacggcatctcccgtatgatcgtagaatgtgcccattccggcccagagcatagcagactccggatacttgtttaatgccttttccagaagcctccgggcttcatcgtagcgcctcatctccgtcaaagctcgggacatgccgatgtatttatccttcgcatgagtgcgccacgggattaatctataaagggctaagccttcttcatactttccgaagtcgagaaaactccaggcgaccttctctctcaggtcatcgatagatttcttgagttcgctctttcttactccgggttggacatgctttaattcttcgagggccttcagatacgttgtcgttaacgcttttaactgcaccgcttcaaccccttctcccgtttcttcgatatccatagtgcctccctacccggctgtttctttgaccgttttgttgatgattaacacgtatgcataattcatatacctgtttattatatattactataataaacatcgatttccgtcctctaaatggcctgttttacggggttttctacccccgaatttcgcagggttttaaaaacactggccggagaagcccttatcacctttccgatctgccgcagggacaatccttttcctctcatttcctggatctcctccacgttcaggtccagccttttgggcctgcccaggattatgccggcttccttcgctcgttttaaacctgccctgaccctctccatcaggatatttcgttcgagttcgcctatggcagcaatgataacgaaaaccgcttttcccaatggcgaagcggtatcgatgccctcttggaaggaaacaaattcaacgcccaaatgtctgaactcttcgagggccgtaatcaggtgtttagtgcttcgggcaaatctatcgaatctccaacatatgacggcatcgaactttcgctttcgagcgtcctgcattaattcatccagggaaggtcttcggtctttggttcctgagatcccttggtcgctgtattctcggtaaatctcaaaacctcgttgttcacaatatcgccgaagatccgcaacctgcatttctactgattggtcctgggtggaaaccctggaatatagcgctactttcatctcattttcctccgtttatttactgtttaattgaggtttaaccactggtatttccttcccttatattcggataagctatttttcggtttccgtatctttttcaattatcgccaaagggaggaggtccatattcatctcctccggcctttctatcccgaactcctttaggacctcctccttcttctcatcgaccaaatcgctaaacattatctttactaccatcttttacctccgccgttcctgccgcttttttcgcccgaatcgtaatccaggctttcttagccgccgccgaccgatcccaagtcttcgctttcttcactgtctccgctttctccaccttcttcaccgtcttcgtcatcttctctgttttctggtccttcttctcgtttttcttcatacattttcctcctttccgtttttggtcgtcctcacccatttttttacctccttcttaaccacgacacctcccttcatctcgattcccattccctaaaaacaagaaaagagcctttcggctccttctgtcccctgacccttcgcaatggttctgcgttttttcggtttaacgacccgcaattccctcataaaacgtctataaactttcaaggcatatgaagcattaacatacgctcttataatatactactgtgcagtaattgtcaagtgaaaaatagcgttttttaggccgcattgttgaataaatacccttatgatatcaaccggttaaaatggtttatcgggggctacatgcaaggactcggaataaagaggatgcaggcgggcgaaacccaacctaaaagttgctttaaccaggttttcgcgctctcaagcgggaatcctggatgactcgaccaatcccaaaagcagggaggggtcagatcgtcgccgataaactaatcaacccaagccatttcttcgcttcactaatatctcgactgctgagaggaataccgcctttacatgagttcacgaatcgtcgttgtagcatttagaagcgctcatagcctgtccaatttattctacgaccatcgtctgcaagtacaagcgtaccagcgaactccttcatcctgttctctttaaagagtactccgattaccttcgtcgataaaatatgatggcacaaggatagcaggacaacagcatctacctcatactttctctgcattgcaggatgccaaatgccctttctactcaaggtgtggtgatgtaaaaagccccgcacatctatcaaatgctctactatttgctcattcgtcttcttcaagaaattctgggtaaactctgcgagtagatcaggatgtgattgaatgcggggatcaatgtcctttctaatatgatcaagtccactcatcatctctgatgaagagcaaaactcagagtggatttgcgcctttttgaatttcccattaccgtagagcgtttcaagaacaaagtacaagtcataaatagcgtcaatgaatctatcctccaatgcgtccaaacggccacggcggtaaaaattcataggtatctctaaatctcgaagatctggcacagcgaggaccgagcggattatcaaatccatgtgagcctgcggtatcctgtcaggcgactgtgcgcttcttgatgtagaaaacgaaaacatttggagggtttccttttcgaggtcagtctctggtatccattcaacagtgctgttgtctacattgatttccctgactccccaaatgcataaagccccttccatggttctaacgtctgagacgagatcctcccaaaaaggatctgggggtattaatatagaagcttttatcttcccatccttcaactgggtaatgctggggagagcactgtcaggaaaatttgaaatcgtcacgaataaatctgttatgaatcctttgtgggacctaaattcaaaggtttgatttcccttttcgaatcttacggtatgggggaatttgacatcacccttgataggaaaaatatatttacatttcacttcatatctccttggttagttcagctcatagtccctccgattgcctaatcaggctttcgagtcccaggtcaatgacttcgtgaagcaatgttatcctttctgcgatcttgtccctcgattctatttttacgctctcgtcaaggcatctgtctcttaccaaacgagcaaagagagcaatgtcggaaaggagaagcgtccgtcctccggggtcaagtgcttcggggatggcccagacctgcccctatcctatggaatcgagggggcaaagtcaatggattttttaggaaacgtggggaggggtaggatctgtccttggtgcttcagagacctcatcctgtcgaggacggtgggatgacaagttcccctgagtggccggagttaagtcaagcgttccacaggaaggagaggaaggtttttatccatcatattccatttccggtgaaaagcgtcaatttctaccttttattcgacgcttttcagttttcatccctatagaaaagtattttgaaaaccgtcaccaagtggttatatttatttgattttacgcttttcatcaatattattttaaaggaatgatgaaaagcgttgatcctcttctttggaccaacgcttttcaaatatattccctataaggtgaaaactgaaaaccgttaatctcatccctgggagagacgatagatattctttttcaccttccccactttcacctcttcgctacggaattccttcccatcgtgatcagatagaatccttcttatggttgattcggattcatcgtatcctttttcgtgagcagctttcgtgatctccttaacgtccagcccatccttctcactcaagatctctttcaccacgtcaagaatctcatctcccatcctaccttggtagacaacaccagtgaccttatctcggtccgtaacctcatcatggtcaatgaccattttcaggttaatgggtttgaattcctcgacccgtgtcttg

SEQ ID NO: 119 - DNA, 12800 bp, synthetic construct
  misc_feature 1..12800: note = Synthetic
  source 1..12800: mol_type = other DNA
tccccgaagataaggactttcctgccgttttagtcaccggagaatggacgctcggccgcacccttcgctttgcaaaggtggtggaggtcaccgttttagtcaccggagaatggacgctcggccgcacctgtggactggcagaatgtgcatgggtattgttttagtcaccggagaatggacgctcggccgcacccgtcgcaatcaacgcgggtgacctggagttgttttagtcaccggagaatggacgctcggccgcacccctgatagcggtagtagcgataattggtgtgttttagtcaccggagaatggacgctcggccgcacccttgcctggcgccagatcacatgctctggcgttttagtcaccggagaatggacgctcggccgcacccctggcaagagtggaaactgagccgttacagttttagtcaccggagaatggacgctcggccgcacctgccaagccttgccctgccacgccgcgcctgttttagtcaccggagaatggacgctcggccgcaccccagttgccattacggtctttgcggagcgtgttttagtcaccggagaatggacgctcggccgcacctgcaagtcgtcgtcaacgcaaaggacatagttttagtcaccggagaatggacgctcggccgcaccgccgcggtggccggcgctcgatccggagctgttttagtcaccggagaatggacgctcggccgcaccttgtatgaggatattgaggaaagatgatgtgttttagtcaccggagaatggacgctcggccgcaccgaatgaagggtcacagtgaggtgttccttggttttagtcaccggagaatggacgctcggccgcaccagccgaagccttaccgtgaactgtggatgcgttttagtcaccggagaatggacgctcggccgcacccgaacgccctatcaagtgtggcttgagaagttttagtcaccggagaatggacgctcggccgcaccccgtcagaagagcggtatcgcggccaaagtgttttagtcaccggagaatggacgctcggccgcaccccagcaactgctcggcacagtctcaagcccgttttagtcaccggagaatggacgctcggccgcaccccatgtgcagtaaccaatttgccagtggggagttgctgcaaaaaacgcgcacaaaaaccgctgcttgccgggcaaaaatcccgcggccaagtgcggtttttttccacttcaggcgttttcggcgattgcggccggcccaatggttcaacttgtcgaggcccgcagccttgattgtcagggcaaaacagcgacatgtccgttacgctaacgatcgaccctggttcgcggaacatcgggctggcgctggtgcgaagccgtgctggcgaccgaccgtcggccctctatgcagcctgcatcgtcgccgagcctaagcccttgaaggagttggtggttcgccgtgcgcaactgcggcggatgcgacgtactcgcaaaacacgccgccgtcgtttgcgccggctggccgatgccttgcggggcatcgccggtgcggaggcgatagtgcgcttctgtcgtcgccggggctattcgcacgatccgaaacgggcgcgcgacggccgcggcgccgacgactcgaccggcgcggacaagctattgtttaacgtctcgcgggaggacttcttcaaggcgctggaagccgaggtgcagcgcgtgattgccgagccggaccgccagcgcgtgctggccgcctgccgccggcacctcaacgctgcgcggctgcctggcagggaattgcgcccgccgcggttcgacaaccgcgcagtgggccgatgccgctggcaagactgcccgcgtcggccgcggcggagggcaaatgccgttgaggagaatctgcggcagacgctctacgaatggctgaagccggtcttcggtgaagcgctggcagggctcgaacaggccgaggctgccaaggccaagagccaaatgtgcgccgagctcgatcactggtgcagcctgctggcaaagctggccgccgagtaccgcaagctggccgacgaacagcccgaccagcgcgacgaaaaggccatcaaaaaggttagcgccctgctggagcgcagaaagaacgagctgtaccagaagatcgtcgactgggcgcaggagaatgcgcccgccaaggcgggcagaaagttcgccgaggattttgaagcctactgcgacaaaaagcgcagcaagggcaagcagaagtgggaaggtgtttcggccgctggcgcgacgcaagcgggcgccgtcgggcagaaaaagaagaagaaaaagaaaaaacgcggattcggcaatcagctcgatgatatcgtggtcaagggccgggccggtcgcttgcaatactgccgcgagcacacggagcagtacatccagtatttcctcgaaggcaaaccaattcccaaccgggaagacgttctggaccgcgacatccgcagtcggcggcagaagatcgtcttcgaccggctttgggcgctgatccgcggccgattgctcccgctggccggcggacgcatcgaccggattgtggtagagcgggtggccttcgacgtgctggccggcaccttcgcggactgccaggagctattcagaactgacgaggagaaagcggccgagatgtactggttcgggccgcgccacggcttcaagaacgagctggagatgctccgcacagagttcgcggggcgctgcgcgtactgcggccagcaatttcaagacctggaggtagagcacatcctgccccggagccgctttcccttcgattcatatctggtcaaggtgccggcctgccgccaatgcaacatgaaaaaaggcggccgttcgatcctggaagcccaaatgcgcatccaccccgatgcgtacgacgcatacgagcaatacctggaaaaacgcgaggtgcgacattacttttgcgacatcaaaaaaggtgtgctcaagctgctgaccaacggcgcccagaactggggtttcgagcggttgctgggaatgatcgcccataacattttcgaacagggcaagtcgcagaacgcgccgcgtgcattggggcgctggctggccggaaagctggagcgcgaaactggcgtgcggccgaaggttgtcttcctcagcggccgccatacggctgcttggcgccagcaagtcctgccggactacgaaaaggcggctgaaaaggccgagggcaaaaagcgcaaccacgcggtggacgcgatcttgctgggctgcgatttccctccggtggcattcctcgatagccagcgaaagtggtggctttcggaggaccgcttgcgccgttgggaagaacaggtcaaggccgccgcaccggaactggcagaccttgcaggcgacggcgatgctgcgccggcaagactgccgcgggtcgaagcgccgccgccgatccggttcttcgaggaggaccttggcggcgggtatttcaaaatcgatctgtcggcctttggctggaatcggcgccggcaaagcggcgcaaaggttgacccggtgcggatgatcacaaccgcaaacgggaaacttgttgccaagcgcgagcctgcgcaagcggtactgaaagatttgctggcagagaaacagcgcgataagcgcatcaagttaatcgccaaccggcgcctgcgccaattgctccagagcgatccggccaacgccgcccggaattacgtcctgtggcttcagcggcagaccgccagaggactgcgcgcggccaagatgggcaatcacccggcggacacaaagcggcgcgaaatgctcgagcagttcatcaacacgccggttgatgatttcctgcggcccagcaagaggcggactgccaagaaggcccagcagcagacgcaatccagcgatgggcgaggcaacggtcagtccgcagccgaacagacatcggcggcagaaattcccgcgatcatcggcgtgtgttgcctgatcgcccagaagtacactaaatacgacgtgccgcgctgcgaccgcaacggcaagccgctgcactactacgctagccagccggcaatacgcgcattgtacgtcggatacaaacgccgcaaagacggaagactggatcgttccaagccggagattttccgcgtcaaccaggtttggaaggtttactacggcccgccaggcaaggaccaagacagccccaaggcacgcaaggtcatcgagaaacttggacaggacagtccgctgcacggacgcatgctcggccagcgtggctcctggcaggagttccgcaagcgatggcacgaggcattcggcagactatgggccgacttgggcgtggagaagcgtttccagattgcgcagggcgcggtgatcgaaaagaccgacggcacatgtttcctggttcggaacttcgataacaccgagggttggatgagaggttctccctggaaggacatccgccgcgtatatcgctcgccgttgcactacctgtccgccaaggccaaggcggcattcgatcactcgtctcggagcgccgcaaccgttgccgaaactatcaactagcccgtaaaggtcgaagcggtttgcggcacgtcggcaacggcgcagcccaaatcgccataacggcgtagcaggcaaaccgattggtctttgtgcgcaatcagtgcgggattatacttttcagcctcatgcagtgtcttacggggtatcaggttgcgagccgtgcgcgcatgttgtagggcatcctgccgtgccacgtgctgtcgtggccgtatttggcgctggttattcgacagccatcgacggaaacacaacccctacacccggccactaactaacgagtggcacagggtaataatggtatagagtggatttgcgctgtctggtacccgcgcggggcgagagccgagtcgctggtaatcggcaatccagccgctaaactgtatcatgacaggccggaaaataccgggggacgccgactacgaagatcccgctcaacactgtcggataccacggtcgatcggtcgtgtaaccgggaaaacggaaggagttcctcgtgccccataaagagttgaaaaacaagcctctggtagaggccatcttggaagtaagatggcgcctgcaacagcctaccaacgagcaacttccggcacagttgatattaccggcacgggacccccattaccggctcttgctcgggcgcctgttcgaccgcattcaaaaggaataccctttccacgaagagttgccgacggcatctttgccggacgacatgctagcgcacgtcgtgcagcatcgatttcgctcggccaaggacgattggccgctgatacaggtcgggcccggggtgttcaccgtcaacgacactcatcgctatacgtggagcgactttcaaaagcgaagcaaagaggcggtagcgcggttgtacgatgcccaccctgccgtcgctgattttcgcgttgagagcctgatgctccgttacatcgacgcggtggagtacaattacaaggatgaggatgctttccgcttcctcggcgacaaattgaaggtaggcattagcttgcccgagactctcttccaggatacgggcgtggaaaggcgtccgcacagtttcttctggcaggcgactttccggtgctccaggccggccggtaggctcagtgtgagctttgcgacaggtcagaaggaaggaaagccggcaattctctgggaaactacggtacaatcggtcggcgaggacctgccgagtatgcccgacggattccccgcttgggtcgacgcggcccacgaaatcaccaacgattggttcttcaagctcatcgagggcgaactcgaaaggaggttccagggtgagtagcaccgcgcacatctgttacgagcggcccctaagtggagagatccctcaaggatcggccaaatgggctttcgacgatggtacgcacagcctcttcgacttccgggtaaggcccgcaagccggcggcttggccatttcgcgcgattggcactcctcttggccatgtcgtccatgagttccgctcaagacccgtgggtgttgaacaggcagcaacattccatatccagcaccggtacgacattccagactagcactcgccggcggataactatgcgcgaagccctgaaaatggctgacgacatcatgcgacgggcggaagaaggccgcttgaaagcgtccgaggaagaggcaaagcgtggattcgactgggagaacttcacgtgatctacgagtttcccaaggatgaggacccgatcagacaaggagacattttcgtcggtctcccccgtgtcgaaatctcgctgaatcggattgcgctggttgacgagcagggtttctatgacgcctcgtggagggaagttgcctttgcaggcagcccagtcaaagctatcctgccggtccggccggtcagtgcgatcgttatcagccaggattgcgacaccatccattcccaggacatctcgttgtgcgaaatccgtgagtttcgggcagtggaaggaaaggcgaaacaaacgaaggacgccaaaggttgggtgagcatcttgactcaacatgcccgcgtaaatttgaagtggttctatttacctccggacaagcggcttggttttgaggacaagatggccgtggatttcacgataactttgcgtgtgccgcgcgtcgacttggaatatctccgcggctttcgcaaggggcgactaaatcccaccgccgacgaacacttccgcgagaggctgtcggaattcttccgccgttatccctacgacgaatggtatccgttggatcaagcggaactagccgagtatcgtaagaagtatcccgaggcacaacctttcccctggcaagacttcgattctccgaaatgatttgtcgtgcgagaacaggaagccttcggcaagcgtttgatacggcgcagcaggcaagccggaggcacacaggcaagccgattggtctttgtgcgcaatcggggcggggttatacttttcagcctcacgtagtgtccttatgggctatgatatgggcattgtgcgcgcatgttgcagggcaacttgcaggaccacgcttttgttgcacggcaacttggagcgctatgccttgttgcacggcaacattgaggggtatgctttttttgcacggcaacatggaaggccccgctcggtcgtggccgtgtgccccggtgccgacggacgctaccgtgacgcgttactccgtaccggccgattaattgcggctggaggccgcgtcaggggtttagcaaagtgcgatgttcgcgcccgcagcgatcggcagcccgccgctaaacaccaaccgtggccttttcagccgcaacgtaacagattgtaccaattgactttgtgtcttggtgtcttggtggtgcgattgccgcttgggcacgtgtagggaagggaaatcggcatgggcatggaagccgctgcgttaccggtagtcagcgccggtaccttcgagcagcttcgcacggcacggcaagttctgttgcgggaaagcgaagcgctggcggagcttgccaatcggttgggagaggagttttgtcgcgcggtcgagctgctgcaaaactgccggggcaaagttgtcgtggcgggcatgggcaaggcggggctgatcggccgcaagatagctgccacgcttgcctcaaccggcactccttcccattttctccatcctgccgaggcgctacacggtgacctgggatgcatccggcagggggatgtcgcactgttgctatcgcagagcggtcaaacacaagagattctgcggctgctgccctgtctggccgagctgggcacgccgatcatcgccataaccggttgtgccgcaagcagtttgggtcgagcggccacggtgacgctggaaatcggcccgatccaggaagccgatccgctggggctggccccgacgaccagcactaccgcgatgcttgcactgggcgatgcgctggcgatcgtggctgcccaattgcgcaacttcggacgagaggacttcgcccggttccaccccggtggaactttgggacaaaggctggccaaagtggaagaggccatgcgcccgctggagcagtgtcggctggcgcacgaggggctttcggtacgggaagtgcttgtcagcacccgcttgcccggccgacgcacaggggccaccatgctggtggacgattccggccgactgagcggcatttttaccgacagcgatctggcccggctgttcgaacagcgtcgggaaagccttttggacagcccgatccgggtggtgatgacccgtagtccactgtgcgtacagcaggggacgatgatgagcgaggccatcgagttgatggcccgacgcaagatcagcgaactaccggttgtcgacgcccaaggccgaccggtgggactgatcgacataaccgatgtagtcggtctgttgccaaaagatcgcccagagcaccaagtttgcccggccgataccgcatgtaacgcagctagcgaccaagaaggtacgtcgggaataatgcctgcggtttatcgcatctacgatgaaccggccaacggtcagccagcgtaatcggtgttgttagatgttctatggagccatcgcggtttcgggttgtgccattggggtggcgacttggcgtgctatcgacgaagcgctgctcgctgtgcgctccaccgggcgaccgccggccgcgaggcgcttggccgaatgggctggacggccagccaatcgccttgccagatcgttgcgcatcggtcgatagaccggccgttgctgtgtgaaccaagcgggcagtagagctggccgatccagttcgcgcgggcagcagcagaaggcgttcgggggaaagacgtctcgcttcggctcgcgcaaagcatagttcctgtcattgttgatgatatccagcaggccgaaactgccgtttgcttcccgcacggtcaagctggccgtcagtttcgcggtgctgctatcgctttactggctgtacgcgttggtggcggtgccgctgatcgagccgtcggcagagccacatcgggcgctggcgcagtcgggcggccagatcgccggcgaagacccgcggctagaggaattgcgcccgctgtttcccgccgacgcctgggaactgcaatcacccaagattatcgaaagcgaccagctcaagctgctgatgcaggaaccgcgaagcctgggcgaacgcagggttcagttgcgtccctgcactatgatattcctgcccaacaaagcggggctgagttaccaggagcgcctcagacaggcagtggtgctgcaatcgcccgagggcgccatactggagttcgatcaaccgctgaacttgcgccggatggaaatggggcgactggtaggcggagaacttaccggcccaattaccatccgtagccaagggcaatcgcccgggccggaagacgatctgctgatcgtgacccgcaatgtgcagatcaacgagaaggaaatctcgactgtaggacgggtggagttccggtgggggcctcacttcgggagcggacaacacctggtaatgaagcttgccccagccaccggcgatgcaccacgacggggagcgaacatcggcggcctggaatcgttcgaggttcgccatgtagaacgcttgcacctggaagtagtcgactggcctggtcaaaagccggcggaaagcccgcgccagcaaccgcgcacggccactccgatcgagatcacctgccgtgggccgctgcgtttcgatccggtccgcaaggaagcgactcttgaagaccgggtgacggtatggagcatgggccagcgcggcccggacaaccaattgacgtgcgacttgctggtactggtgcttggcgatcagaccgacggccgtccgcagcaacagcagcagccacaacagcgctcggccagcagcgcccctggtggcgtggaagccggccagccgcaagaccgcggcgatcgcctgtcgctaagcctgcggcggattgtggcacagggcactcccgctgtagcgatggttcccagccgtcagcttgccattcgcgccggcaggcttcaatacgatctgctgtcacagcggatcaccctggcgggggagccggaagtgatgcttcgtcaaggccccaacgaagtgcgtgcgcgcaacctggtctatgagtcggcgggggccgagaagctggggcgacttttcgccgaaggcccgggttggctcagagcacagttgcccgatcggcccgaccagcagctttatgcccaatggaacgagcaccttcgctttcggccacacgagcagaatcaattgctttcgctgaccggcggggcaaggttgcggtttcgtggagtgggcgaagtggcggccaaagagattcacttctggttcacggaaacccctgcgccgagtccggcggctgctgtgccgactgtggcgcacggggcgcccaaaacggcgcctactgctttggcacgcgccgcagcagcaccgctggcccaatcgcaccgccagacaatccggctgcgtcccgaccggatgctcgcccaacacggcgtggtgctcgactcgcagcaggtgactgctcggctggagcagttgggggtttggttcgagccgagacctttggcagagcggctttcgccgggcgcagccggtggacatggcagcggccccggacctgtgagttcgtcttcccataacgaatcccagccggcggccctgatccccgatgccgccgcgggccgcaatgcgccctctgcgctgccggcggctgacagcgtggcgggcagcctgtccgtcgccgaggctggcacaagccctctgtcggcaacgggcttgcgcggattgctggcagaaccccgtcggcgattcgaagcgcaaggccgctcgctgcgggccagagttctgttggacgaggatatcggcgagcataataccggccagtcagcaccgcaggcagaaacccagaatctttctcaacaaagccctggcgccgaaatcgccgagttgattctcgaagacgacgcaaggttcgtggaactgcttggcgaaggagcgtccgtcccgccggtggtcgtcagcggccagcgcatacacgtcgtcgaggccagcaggccgcacgctgcaataaccgtggtcggccggccggccttgttcgagggacgcggtttgaaactcagcggcgggaacatcaatctgaatcggggcactaaccggctgtgggtcgatggacctggcgaattgcaactgccgttgaagcgaaatctggactttccgctcaaacaacctctggagccccagccgccggcgcaacccggcacgctgcgcatcgattggcggcagcggatgcagttcgatgggcgatcggcgctgctggagcagtcggtcacggcgcgcggcccggacatggtcctctccaccgaagtactggaagtgcagttgcagcaggggatagttttcgccgagtccggccaagactcccagccacagatcgaacaaatactttgccggggcggggtgacgatcgaaagtcgccgtctgcgggatttggaattggcatcgctgatgcgcgccaggctggccgatctggcatggcacatccccagcggtgcgattgccggcggcggaccggggttcatggtgggagtgttccgtagcaccggcccggcgaaacccccgaaccttgtgctgccgtttgccaagccgcggtcgccagaagctgcggccgcacaaggccgctcgggcgctccgctggattgcctgcacgtgcgattccaaggctcggttcggggaaacaccaacaccggcacgctggggttctacgaccgtgtgcaggctgctttcgcaccagtagcttcctgggatgctacgctggaagtggatgacccgcgagccttggggcaatatggcggtctgctgatcaactccagttgtctgacggtgaccgaaatgcccagcccgcccggcaaccagcgaaccgttgagctggaggcgaccggcaacaccatcgtggaagcggtcagcgaagaccagcgcctttacaccgcccgtgcccagcgaatcgcttatgcccaggcaaaagacttgcttgtgctggaaggcgacgggcgcacagacgccgagctgttttatcaaccacaacccgcagcgcagccctcgcgccaagctgcgcgcagaatcatcttgtttccacgttcgggcaaaggttgggtcgagggggcgcgcagcctggaactgaccggctttccccagtgattgtgcgtgcaagtgccagccgctctgcggctggccagttgttgcgacccatcgccggcgcagcgttgcatcgcaacagggccataacgcagcccgcggccgcaaccaaatggcagcgacgcgctgcggttgcgtccgctagcaatgggaccacggccacgacggagcgtggccctccagatcactcgaaaacatgcgcgcaaaatgagcacaggttacgtcgtaaggaactaacacccaacgacgcccgacgaacctctgcgtcgaactgcttgccatggcggggacaacaacggcattggcggttggaaatcaaggcagttgcgatgtaatggacgacaaccgcgatgaggttggaaatgcagggtttcttctctctaccggtgtatcaagtacaattattgccactggggcggaataaccgggaaaccggtcggcacccgcgcagcccgaacgaatcggttagcaatacaccgtgcttgtagcagtggagcttcttggaagccagaacggctcagttcggcctgcgcgaagcatatcgtacgaaagtcccgcgtgcggacctggccgattccggctacagtt

SEQ ID NO: 120 - DNA, 11185 bp, synthetic construct
  misc_feature 1..11185: note = Synthetic
  misc_feature 5738..5769: note = n is a, c, g, or t
  source 1..11185: mol_type = other DNA
tttaaggttaaattataagaaaccgtcgcgaccgttgcctatcatttcaggaatcccgcctcctgcaggatttctctggcgcgcggaacttgatcttgctgaatcagcaggcgggcataagctcccgcggcaaccagcatcgcggagttttcgccctgaaagaaatagtggatgtcttcaccatccagcacggatttgataaacgcgatgtcgccgggattgtacgtggaaaaaacctcgatcatctccacatagcgcacatccccgtcttctgaatccgatgtaatgttttccatgaagcgatgatacacaaaaaaggattattatggaacaccttaaagggtcgcaacgaaaatatctgcgggcgcaggcgcatcatttgaagccgctggtcatgatcggcgcaaaaggcgtaacggaacagttgcttggctccgtggatctggcgctcacagaccatgagctgatcaagatcaaattcggcgaattcaaagaagccaaaaaagaaataaccgccgaaatcgcgctggccacgcatagcgaaatgatcggtctcattggcaatatcgcgattctttaccggcaacatcccgatttggaaaaaaggaaaatcaggataccgtaaagctcgctctgtctgtcgaaaaaccgtgcttgccggttaatgccggccacggagagtattaaaatttattgacatcagaaatcacattatatatagaccctgctcgcaggccgtgtgcattatccaggatcggccgcgcaacgctcattcttgatggggaatcgttcaatggtaggacgccggactctgactccgttaatcaaggttcgaatccttgttccccagccaaataaaatcaaagacttagaagacataaatttttgaacaccgttaccctccttaaatttttaccgctattttaccgcttttaggcaccgttgttggtaaatttcctcctactttaatggcatgatcttgccacaaaattgagtcatcaacgtacaatcatttattaaaattaggaccgatatttagcaagaaataagggcaattatacagttatagcagatagttattgctattggctcaaggctgttagggtcttgattgtggggccatagggccacaatccgcgcatgaagcgccatgcatcacggcaacatggcaacattctcaagtctgcatttatcaattttattttccccgcggctgtggtatagataaatttgtcttagatttaaattacatatcatattcaacgtaaatatttccttgcatctggttagctcatggagaatatcttgcaaactggaagaacttatacactcggcatcgattatggtgcgtccaatgttggcattgcccttgtctgtaatgaacctactggagaaaaccttccactgtttgccgccacacttaggcttgatgcgcgtgatctcaaggaaaaagttgaaacccgtgcaggcatccgcagccttcgccgcaccaagaaaaccaagaagcaccgactgcatgatcttgcagacgcgttaaagtccattggtcttcctgaaagacaggtgcaatccgttattcgtttcagtaagcgccggggttacaaatcgctttttgatgaagatctgcatgatgaaacagaggagcagcaggataccgactttgtttaccgtttctcacgcgaagtatttttccagtccctgagcagcgaacttgaaaacatcatagcagatccagttttgcgattaaatacattagcgcaatgcgaacgaatcctgaacaagcaaggaaaccctgaccacgaaatccgtcggatcagaatcgacaaccggggggcaagccgctgcgcttgggcgggctgtaaccgcgtaacgccgcgttcggataatgcgatcagggatgtgctcgcccagcagctttacaactatttccaggccctcctgcgtgacaatccatcacaatcagccaaagttgaagacgttattcaagaactggtagttattgccaagagaatccgtgccgcttcaggagaccatatcaaagaggaaaaaaaggcgctcaggaaaagggccagaggggcactgagaggtctgaacaagttgctcatgcccgttgccaccggcatccccgaagacgagccctgggaatacgtcgaaaagggaatgatgaacaccatcgagagacgcgcaggccgaaaccgttactgtcgcgagcacagcgccgaatatgtccagacaattcttgccggcaaggctgtccctttcaagaaaacgatcactgacgctgatattatttcccgacgtgagcagatggcctattccaagctgtggcgttacatcgaagctcgcatattaccattggcaccgcagggaattgatcgaattgttgttgaaaggacggcgttcgatctcctcgccggaagctggaagaccatccagggcgcaacagataagtacaaggaagaaatgtatcagcagggccccatgtttggtttttcatccaagagggagatgctcaacgaagaattcggtggactttgcgcttattgcggaaagccgtccgcggatctgatggatcatgatcatattatgcctagggcggacttcttctttgacggatacctgaacattctccctgcgtgcccgacctgcaacaccaacctgaagggaaaacgggcgttatccgaccaggcgctgaccatcgtacccgaggcctatgaagcttacaaaaaatatctggcaacgaaattccggacccgtccgatgcatttcctgcacaccgtaaaaaagggcattctcaatctgatgaaggaccccgatcgcatctgggaagcggaaaaatacctctccatcgtagccaggcaatatgcgcagatcgtccaaacgcagagaagccccaggccttttgcgaggctattgtgccgcaaaattaaagaatcgcagggttctgaaccctccattgcttttcgaagcggccgccacagcgccctgtatcgccagattgcctaccccgaatttgaaaaatatgcagacaaagaacaggggaacgtcatcaaccatggccttgacgccattctccttgcttccagcctaccggacctttaccctgtggaatcgctgaacatcccaatagcaagactaaagggctggaccgcctctgtcagaaaaagagcaccaagacccggttccgacgggattcccgccatatctgtaaaaggcatggttgatggctttgaaaagatccatgcacccggatatatcgaagtagaagtccgggcaatggtctggaacaagaaaaacagcaggactcacaagcaagacccatatggctggtctgaatcgcaccacatgcctacaaagcgtaaggcggctgccgacctctatgcggatatgacgaaagaaaacagcccgacaagactcaaggccatggtggaaagaatttaccatccggccctgaaacacttcattttgggaaggatggacacggacaaaccggggcaatccgctgcggcggcgctgaaagaatggttacaggcatccatcagaaatagcctcccggattcacaattctccaatcatccgggcgatcaggcccgcaaggctgatctggaaatgtttgccgaagttccggcagcaccgatacccgctatcatcggcgttaagatgatcgacacaggcgtgcaggggaagatcgatctggagagaatggaccacaaaaccggtcggattgtgcatcgctatatgactgatcctccgaataaagcggtttatgtggcctatcctaaaaaacgtgatggtggttcggacatgacgaaaccatgcctgcttttcctgcgtcagaacgacgctattatagtcgaaagccttgccgcatttaggccgctgccggaggaacttgccaggggccgtgtattgggcagcacacaaagcaaaatttttgatgctgcactattggagaaataccttgaagaatgcgggttccattgctatataagattaacgtccggctgcgtgatcaactatgaggacggaaaacgctggttcgttcgcaactttgatcagagcaaggatttcaagaaggcaagattgagaaacatcaagggcgttcagaagacacctttcagcaggcgcatcgaacctcttgtgtatttgggcaaatgatatttgtccatgacaggttctttgacaatttagaattaataatcagttccggttgaaaagagcatccgccggacagcgcactccgggatcgggcagtcccggcacttgcagtttccccggttagtccctcggaaacaagccgtccggcatgtcgaaagacaggatgtgagcccattaaaaaatgaaagtcattatgatattcaattaaactgatttcagacagtcgttgcgacctttaagagtttcttttccaggtcatctagaccggtttcaattaaactgatttcagacagtcgttgcgacaaaatggttattcagcctcagcattctccacggggtttcaattaaactgatttcagacagtcgttgcgacgtgtgtcaacccattacgccctgaaacgtggccggtttcaattaaactgatttcagacagtcgttgcgaccatatcgcctgtgcatctcgatcagcgccgcctcgtttcaattaaactgatttcagacagtcgttgcgactcctcaaacggtcgtctctcagccatacctcaatgtttcaattaaactgatttcagacagtcgttgcgacatgaagggggctttttatgattgattcacgatgggtttcaattaaactgatttcagacagtcgttgcgacgtggaacctataccagggaggcatagcactaaggtttcaattaaactgatttcagacagtcgttgcgacatcatctttttcatcaatagtaatgatattcttagtttcaattaaactgatttcagacagtcgttgcgacacattactgtgataaatggtatccagacgggttgtttcaattaaactgatttcagacagtcgttgcgacctaacggcggcgcggcacaagtcattgagaccgtgtttcaattaaactgatttcagacagtcgttgcgacaacagatttgacgattaccgatgcctatggcattgtttcaattaaactgatttcagacagtcgttgcgacgtctccgatagtaggaacagttacagtgtagccgtttcaattaaactgatttcagacagtcgttgcgactgttgttctaaattgtcaaagcatttcaattatttttatatgcatttccgcgaaactcccacagagaggggattgttgcgctgtaaccacagttaatcatcgttcattttagaatctaacataccaatatcaaaaggtttttaattttccgcgaacccctgaatcccataatttacaaccccaagcgaggatgttcagcaatgagcgaagcggcacggtggaaattgatctattaataaaagcttccacatatgcattccatctcttccaatctcgccgagcacaccgggcaggatgcggttaaccgcgtcaggaaactttacggcgtaattgcggaggtcatggttattaccgtcgatggcgacatgggccacgttgaattccgggacgcgacgccggataagcacagggaagccatggaaaaactccgcgctggaatccgggaggcgcagcagggtcagcttgcaaaggccgtgaacctcttcaaggaagtccttgccgttgtgccgnnnnnnnnnnnnnnnnnnnnnnnnnnnnnnnntagcaagtttgtggatattaactttctaaaattgaacaaatattcaattaatgcttgctttttgcataatatatgcaataatcactacaaaattagattatgaaatggagaacgttatgttaattgaatttaacgttaccaactaccgttctatccgaaataagcaaacgtttagcatggcagccagtaaatattatactgaattgggagaaacaaattgttttgatatcgatgtttctggattgccgaaacttctccggtcatctgtagtctatggaccgaatgcagcgggcaagagtaacttatttcgcgccctccatttgatgcaaaagttcgttcttaaatctcattcgcagcaggaaggccaggtaatcaacgccgtgcctttcgaattagataaactatcaaaagaacaaccaagtgaatttgagattttttttgtgcaggataatatccgttatcaatatggatttgcggcaaacagaatgcgtgtcacgaaagaatggttgctggcctttccggaaggtaaagcacagcgctggtatgaaagagaatacgatgccaattctgacaatgagaaatggtatttcggaagcaagttcactgggcgtcgtcagctttggcaggaagcgacacgaaagaacgcgctcttcctttcaacagccattcaacttaataacgagcaactgaaacctgtattcaactggtttcagaataatcttactacggttttaccttctgatcagatcaatcttaatttatcgcttaatcaatgtgaatctgaagaaggctgccgtcgtattatggaatttttgaattccgctgatattggcattgctggaattgaaatcaaaaagatcccatttaagcccgaaatgctttcccctgatatccctcaaaaaatccgggatacgtttttgcttgaaatgaagggtaaggacttaccggatattcattttgtccataagacaaacaccggtgaatcagtaccattccgtttctctgatgaatctgacggaacacaaaggttattcgcgtttgccggcccctggctcgatgtattggccaaagggcgtgttatttttgttgatgaattaagttcaagtctgcatcctttgattgtaaggttcctgattggacttattcagaatccggaaatcaacaaacacaatgcgcagttgatcttcaccacacatgatacttccgtgcttgattccgatattttacgtcgcgaccaggtctggtttgttgaaaaagatggcgaacaggcaagcaagctttatccactgagcgattttacgccacggaaaggggaagcgctagaaaaaggctatttaaaaggtcgttacggagctttaccttttattggcgaattgaggttctaatgggaacagataatctattccacattaataaagcacgtaaagcagaatcacatcagcggaaaaaagcaagacgtgatccatacgagcgaatgctgattgtttgcgagggtaaaaaaacagaaccaaactacttcaagggtttgcgtaaaacctttggtcttaatcccatgaatgttgtcatcgcggacaaaaaacatgggcttgatccgatgagccttgtggaatatgcaattgatgagtataagaaagatcctgactacaaccatgtttattgtgtatttgaccgggacaaacaccaaacttacgatgctgcccttcacaagataagtgtttgccgcatgaaacggggtgccaaattacacccgattacttcaattccttgttttgaaatatggttgcttttgcatttcgcctatactaccagatcattttgtgcagcatgtgatgattctaatgcagatttggtcatctctgaattaaagaattatatgcctgattatgaaaaaggcgctgaaaatatttttattggtgatgagcgtttagatactgctatcaataatgcaaagctccttgaaaaattccatatgaccagtagaacggataatccatctacaaagatttatcagcttgtggaatatttaataagctacagaagtcgaaaggtttaattggacatcttgctgatgcaagtatccttgatgccgacatcaataaagaaacaaacggtatcaagcaggcctacaacatactatcaggcaaagggatagacggcctccatgacaatgccgagaaatccttccatgttggagcgacgaagattcttcacttcctgaatcctgcattatttattattgtggacagtaatgcaactcgggcattccgcgagtgccatcacgttcctttcaaaaacacaacccagccaggttatactgctgaactttatgtaaagtgtgtgcaacatgttcagcaagatattaaagatttcggtttcgacaattttcagaacctggatcccagcagcccaataacccgaatttacgataagctgacatttgctaccgggtctggatggttttgaattacggaagatgtgttgatattgaatacaatgcactgagtgaaccgacaaccccatcaattttgccttaacttaaacaaacatatcactgcacctattggctcctcggtgcatgtataattcacactcaaaacaaacatgagacgaaggcggaagctccgggcaaccggggaggcaatcgacagacgcccggaaacaacgcctccgccccctgctcaatgcatcactgcacctcgggcttctcaccatgctcaaaccgcgcctggcgggccaccttcagagcgttcttgatcggccggagaatgaacttcactgaaacattacgtcaggctccggatgccctcttttgtgccaacaattggaatttgtcatttccccacagtgatgatataaaacaaatccattgtggaaaattgcaattaaaatacgaatcattgaaagtacatgagatgaaaatatcaatccccctgaaagacatcatgattgcgccgggcaggcgattcaatcccgctgaacataccggacaggatgtgatcaagcgcatcaggaaagtttacggtgtgatcgcggaagtgatggatgttgccgtcgataacggaatggtccatatcgaattccgggacgccacgccggaaaagcaccgggaagccatgaaaaagctccgccaggggattgacgaggcgcaaaagggccagcctgcaaagtccataaaccttttcagggaagtccttgccgtgataccggaaaaccttgatgcccgtcgaaacatggcaagggcgcatctggatctgggcagcatcgagcaggccaagaagctttaccaggaagtccttcagctcaaaccagccgatcatgacgcggcaatcgccctcggcaacatctacgcccggaacgaaaacaaccctgaagtggccgcgttctattacgacctctgcctccagcaccaccccgatgacgcgatgctttcctgcaactacgccgccctgatgttccagaccggcgagttccagaaggcggaagtcctgttcaaacaggccgtcaggggcaacctgcccaacgcctactacggcctcgcgctcctctataaaatgtcagggcagccggatgccgccagaagcgtcctggagaccatgttcgcccggataccgcatgccacacttgccgggggacacgcggcgatatacgcggaggcgcagaacctgtacaacgagctggccggaggatcgaaacaatgaaggatttcaattacgcgctcatgctgatcaaggccgggaagtatgatgctgcgagggacatcttcgaggaactcctccggaacgacccgcgggacaaggacctcctctacaacctcggcatgtgccacagcgaactgggcgatcccgaaaaggccgtggcgatcctgtcggaatgcgtgaagcattatcccaattactcaaacgctcatgtcgcgctgggcttcgcccaagtcatgctcggacaggacgcgaaggcgaaggacaatttcctgagggccctggagatcgaccccgtcaattcgtacgcgctcaggaacctcggcggcctgtacgggaaggagaacaacttcgacaagtccatcgagtgccttgaaattaatgtagataaatgtgtgattttttgtgactcatgaaaactgaacctaaaaataaagagcttctttcccttcagaaagaaaatcggcatttgaagcaaagcatcgtcgtcatgcgcgaccagcttgaggggattgcccgcgaagaggctgcgcagaatacgctgcgtgccgcgcaggacgaaatgacccagcttcgggcaacgattgccgccatgcgtgatgaaatggagaaagcctgttacgaaaaggactgcattatagagcagcaggccgtcgattccagcgatgaaaacaaacagatgaaggatgcgatcacggcgctgcgcagtgaagtggatcgccgggaagccgcccatcaggaagaaattcaggtgatgaacagaaaccatcatggcgaagtgcagcagttgcagcagaccgcaaaggcgctgcgggaaaagttggtggcgctgaaaaccacgaaaccgtaaaggtctgacaaacatgaaaaaacatcagaacaaaccgggcgtaaaaaacttgagcatcaggaagatgcggtcgctgctggatatttcccggaaggtatcgactctggaaaccctggatgaaatactggcggagctgataaaaattacaaccaccgagatggatgcggaccggggaacgattttcctgaatgatccggaaacgggagaattgtattcccgggtcgctcagggaaatttccagcgggaaatccggttgctcaatgccagcggcatagcgggaacggtgtttcaaaccggtaaaagcttaattattcatgatgcttacagtgatgaccgcttcaatcagtccgtggacgccaagaccggctatgtgacgaaatccattctctgcgttccgatccgggccgcccgcaatgaaatcatcggtgttgcccaggtactgaacaagaaatcaggggagtttacggaagatgacgtgatgctcctcgaagcgattgccacgcaggcggccatcgccctgcaaagcaccatctttaccgaacggatgaaaaaattccgcaccaaggagatgaagtttttcgatgtggtcacggaggcgacatcggaaatcaatttggggaatctcctgcataaggtcatgtccgaggcgatgcggatgacggatgctgaacgctccaccctttttcttaatgatgataagaccggcgagctgtattccagaataggcgagggattggcgacaacggaaatacgctttcccaacaatgtcggcattgccggatcggtttttcaatccggcgaaaccattaatatccctcatgcctatgccgatctgcgattcaatccgtccgtagacaggaaaaccggcttc

SEQ ID NO: 121 - DNA, 9428 bp, synthetic construct
  misc_feature 1..9428: note = Synthetic
  source 1..9428: mol_type = other DNA
atcgctttcccatgtcaagaatccaccgtagaatcgcccagactattttagaagacagaaacaccagagcctaggatatgggatcctttgtgcatattttccacccttccttcctgtaactttcccttccctaatctttcaaaaaggtatatattacaaaccgtaattgtaggcactttaattatccttatggggtttcttggtgggttagttgttttgtggatcgttgttttgaggtgaaagaacatgagcgatgaacaattaacaaaaataatgtatgtagtggtggctttgttggtctatttcttaccctccattctcggaaagaaacacaagaatttttcctccatcttcgtaatcaatttatttttgggatggacacttattggatgggtggtagccttggcgtgggctgtgaagaaagattgagttattgctttcaggatcgctctggatctcccccgagtcaatctcaaatcccttcaccattccttcctgaaactttctcttccctaatttcaggaaaaggtgtatattacaaaccatatttagcggaaattataacggcatcgcacacttaggaagtcgagcgatggttattgcccacactcgaacggagaacaaaatgaaaaaggtactgttggtgatggcaatggtttcgacacttatggtatctgtagccttcgcagagattcccccagatggtggtgactactggtttccaccaggaagagctgcactccattctgggagtagcgtaatatttgtagcacaaaacactgttcctggaaaagcagtcacatttagaccttcatttagttatgataaactgacatggaaaccaatgtcatcaagtaggatagcctgtgatatcagtggattcaccacatttgaatggaatgtacctgttgttaaagctaataaaaagatttggtttaaaatggcctctttcaatgcagctggcaaaagaatagatttggtcatatcccagtgggcaaatgaagtttggacaaacttagtaataacaaaagttagagacataggtgctaatcaagtgaatgataataatagatcatgtttcgcaaaagaaacaatagaactaatttgggatagtgacttagaacatttagattcagtatttatcaaacttccatttgttgaagtatctcaacattgggaagaacaaagtctgcaatttacgtgtccaaagcccagtgttcaagcttgcaaggctgctgtgacagcaacattagttggaaaagatgatgttgggaatgagattgcttctgatacgcaggttattacagtttatacggggtacaaaccacctataaatggttcgtggtcaggttccattgaatttaggtctggggaagaattcaatgtgaatggcagtgtaagtggaacaggctataatagaagaatttcagctacaatgttttccaccccaagtcaaacttgttcaggctctttatggatggaagaatatgcttgtactacaggagatatagatgtaacttgtaggcttccaagtggatattattatccttgtaacgggagcgattcagtagaggtgtggggtggatgcaccacggatttgggaggcacaaatatagtctgtaatgtgagaaattcatgttcttccaaagcaactattcgattttccagataaataagtggaataaatgctacatttcttaacagcagccacaaaattgtcctacgcttatttcatcggggctaagtctgccagcctatttggtgaagtcaagcattagtgtcccaacgttgctaaaaatgggcatccaaatgttgtaagtatttgatttcttttgaagtgaattttctgagacaattcaaatcaaaaaaaacttagacagcgagaaaactcaatcctgatgcggcttctctaaagttataacgtgcaacgttgggacatttctggaagtcaagtatactcactttcatctggtaacttttaaaagataattttcacaatgtcattttaggcattgacattatgcacactttttgtaccataaaaccaacaggtcttcacaatactttctctttcagagggggcgtggatggagtaagacctttaaaagtgtgctcatgtaatctcttgaaagttcctcttgaaggtcacttctttctgcagtctcaaattccctttctgacttatatgttttaaaggccttccaaacttcatgcgaagaatcagaggcggaaggagggtaaaatgaaaaaaccattatttctttcggcgctctgcgtcattttgattttttgtctaaactcggtctgttattcacaatacgtaataaaaaagatatccagaaacccttattatgacgatacaaatcctcagataaacaataatgggcaggttgtctgggagggatatgatgggacagactgggaaatattcctctatgatggatcaaccacgacccaactcacaaacaattcttacgatgacactcatccacagatcaacgacaatggctacgtggtctgggagggatatgatgggacagactctgagatattcctttatgacggcattgacaccgtccaaatcacggataattcttacgatgaccttgatcctcagatcaacaacaacggctatgtggtctggagggatcggcatctatactttggagggccggacagtgaaatatacctttacgacggctccaacaccatccaacttacggataatgcattttccgactttgatccccagataaacaataacggggtcgtggcttgggttggtaatgggctcttcctatatgacggcacaaccataacccaactgacaggggagtattcttacggaggcgaagatctccagataaatgacgacggttatctggtctggtttgcggatcatgcagcagacgaaggtggcgtatacatgtataacggggcagagattatccgggtgataaaaaaccgtggttatgagaaccgggacccggatatgaatgacatgggtcatgtcgtatggattcgagagcccatagagggtggacctggtaaagtcatgctgtttgacggcaccaggaaagttcaactcacaaacaaccttgatagtgaaaataaccccaaaataaacaacaaaggggaaatcgcttgcacgcgatgtagtaccagtgggtgtagcgtcatcgtttataatggggtaacctttaccgaactcacaatcagcccccgctatgttttgggtcctcaaataaatgaccacggctttgtcgttttccaaagcttttccgaatccaataatgatatctatcttgcatcacgtgtgtcggtaatctctcccgacggtggcgagcccgttccctccgggcaagcttacacaatccggtgggcggggccatcccaggcagtgaaatacaaagtcagatactccatggacaacggcttaacctggaacaaggctcatcagcaggcctttgtaacagagaagaccctggactggaatgtacctgtgctacccggtaacaagcgaaaatgcctcgtaaaggttgcagggttcgatgcctccggtacggcggtgagcagagaccaatcggatacaccctttacgatcgagatcttgaggctaacatcgccaaatgcaggagagccgcccattacatcaggtggacagcatacgatcacctggacaacaaacgatacggttgccgaggtgcatcatatcgttctttcgtacacactgaataatggacttacatggaagaaaattgatacgagtgcagactcagccgatgatggaagtttcatctggaatgtgccggatgtttccaaccagaaggataattgtaaagtgaagatcgtcttgaaagactcctccggcaataccgtcggaagcgacgtgagtgacggcgttttcacaattcagcctgcacctttacgctaactaccggcgaaggcggggctgagggaaaaacctcggtcctctcctctctcattgtgaattgagccctgaatatatcattcggtaatctgcagcagtttcaatttctaatacctgtggacttgtaggtgctatacgtcaaattggaccttaggccagcctggattcggaaaagagaggagtacttccttgaaagtttctattccctacttttttaaaatgctgtatattacaaatgcaaatgaacaacgcagatatccctgggcaccaatgaatagcttattctgaaattaactcgattctatataatatttttaatacaaccttttctagacaaatagcctgatattcgacctttttgactgaggaaaccctttagggcttaaagatttaataaaaatatagaagcagcttaaacaataagttatctgctcattgtagacagagaaaggagttttatatgttcaacatacttatttcctttgtctttgtatttgtttttatctctcctataaatgcattcgcccttgaaaaaggtgaacagataaaaatattccaggaacggattagagggctacagaggcaaggtatccttccaataattgatacggagtttcatcatggcggtgaggtggaggtcgagaacctcatcaaagagatggatgagaacggtgtggccctgatatggcttggatcgattcaaaaacttggcagtgaagaatctcagaggctaaatggattgcaccctgatagattcgtccctacgactattcacggtgatagtaaactatggcacagtggcaacaaacgttttcttgaaagactcgcaaaggatgtgaggacaggaaaatactttgtgatgggtgaattcgaagccagacattacccttccagcacaaatacaagagatgaacatacgactgtcgactccgaagccatgcaggttgtttttgagctgtcgagtgagacaggtatggtatttttattacaccatgaggcagaagatgttctgcttccggagttggagaggatgcttgttaaatacccaaaggcaaaggtgatatggtgtcatgtcgggcgcaacagaaatcctgaaacatggataaaattcagaaaagcagacgcggcgaaggaatttttatcgaagtatcaaaatctgtattttaattttcttgcatcgcaaccaggctctaaatatcaaccaggtaagggatatgccgccaaaaaacgcgctgaaggatatgtagagggaattatgtatgattactcctctggaggtgtatcgctttcatctgaatggaaaaaagtaatagaggagtttcccgacagatttgttttaggctccgacgctaatactggtggcggtttagaaaagtttgaaaaatatgacaaggtaacccacattttccgggatattattcttacgggtgttaaaaaggatgttgctgaaaaaatagcatttaaaaatgcatggaagttaatgatagggaaggcttgggaagattgagtaatgcttttgcccgcaacaagcgataacaaatcaatgaaggcgacgagtaatagcgccgtgccttttgaggaggtcaatgcccccgcgctttatttctatcgttatactcgattccaatcgtaaatcttcaggtgatgtagatagcgtatcctaattctttgtaggtgcactcgccaacctgaagccaacccgacaatatctgccacgtgagagatcccttttttaccagtaatgcgtcataatgcgaatataggaggaaataatggacattctggtcgcacgcacaaggggcagaatttccaaagctgccccgtaacttctcaattttctgatctgacttcgaccgcttcttcaattcttcacattcttcttgactttcccatctggtttgaatagactcacctcaccaaccttgagtcagcacctctgactaagcgtttacgagttggccaaacaaccaaacctctaaccttttggacaatgttagctcgtattattcgcaccaaagaaattaaattctattggtgaacgcattgtgacttccgcggttaccctatccattgacttcggttacaagaacattggccttgccctggtaagaaatcaggaaggggttaacactccattgttcgccgggactctccaatatgaccctttcgcactcagcaagaaggtgggacccagggcgcaactccgcaggggccgccgtaccaggaaaacgaagagataccggctgaactctctgaaaaaagcattgtcaaaccttaatctgtccgaagagggcatccaccagcttgtcaatttctgccgaagacggggatatagctccctgtttgaaccaagagcagtttccacggatcggggaacccaacctgaagaagaaattgtctttcgctttagccgggaggaattttttgccgcattagagaaagaaatagagcgacttctcccagaggaacagagaggatcggttcttgctatctgtgaaaaaatccttaaccgggctggtgaaccttcgcaagaaatccggcccctgagaatcgacaaccgaggagcctcccgttgcgcctgggacggctgtgataatgtccctcctcgcagggataacgccctccgggaccctctttcccaactcgtccatacggtatttgcctcaagtctcaggggcgacacagccctccagcaagaagtctcaagaatgttggaccgcatcgccgaattggggaaacggctccgccatcgtggaggtccagaccccgataaggagcgtaaggcccttaaggcagaaataggtgaagaactgaaactgttgaagaaactgtatggcttaaaccctgatttgaccgaagagaccgctactccctggacaaagattcggcagaacataacgaacctgatagaacagaccggagggcgcaacaggttctgccgctaccacagttctcaatatgtcgcccacttcatggagggaaaaccgatacctttcaaggcaactttgaccgaaagggatttagtgtctcgccgtgaagaaatcctgtttcaaaagatatggcgctatattgaggcgaggattctcccacttgccccggatggcattaaccatgtgatcgtggagcgaaccgccattgacctccttgcagggagtcgtaaacagcgtcaagacattatgaataaagaggcccttgaggagatgtatcagcgaggcccccggtacggattcacagatgatctggatatgctgagagaggagttcggcggtctatgcgcctattgcggccaggaacacgctgaactggttgaaagggatcatctccttcctcgttccaaattcttctttgacagttacttgaacatcgtgccagcctgtcccaattgcaaccggagccagaagcaagcggcctcaccagaacaatctgctctccatattcatgaaaatgcctatgatgcatattcaagatattatgattcgatcagggagaaccctcctcatgtgtttcatactattaagaaggggattctgaacctcatgcgtgatccaacccgtacctgggaggtagagcgcttcctcagcctcatcgccaaccagtttgcacaggtcacgggaacccaacgagggcctcgcccccttgcccgttatctcagcggaaagatttaccagaaatacggcgagaagccccgcatcggcttcgtcaacggaagacataccgcactgtggcggaaggcggcttacccggactttgacaaattcagggacaaggccgaaggtggggtcgtcaaccatgcccttgatgctttgcttatggcctgtgacctaccggacttgacctctttggaggcgagaaacctccagcccagtttgatgcaatggtgggtaaacaaggtgaagaaggcggccccgcctgaaggtcccgaaggaatacctgagttgcctgaaccgaattttgctgtgcctggatttgaaaaccttctgcctggaaattatgttgaagtcgatttagcgaaaatgaactggaatcataaggactccaaggtacaacgtcagggtgcttatggctggtcgatacaggaggacctccccgttcagcgtgtcacagccgcaagcctggcggatgagatccgccaagcagacaagaagaaaactcctgagtcccgcaaatctgaggtcaagaaagcggtgaatttggtcgtccatccacgactccgcaaagcgcttgaacaagcgaacaatggcaataccccgggagcaatcacaggcgaggcgctcaaaacctggttgaggaaatcaatcaaggggaatcttgataaggcccacttttcctctcacccggcagaccaacgcagagcaaagatgctccaagattttctcagcggacaatctgaaggcatccctgcggtcataggggtcaatacttttgtcccctcgttaaagtccaatacggatttgaatcgaattaaccctgcgaccggtcatgttatacaccgatatgttgccgaccccgcaaatgttgcttacatagtggcctaccagaagaagaacggtaaggtcaaacgggataagccgttgacccttgagtggcgccagagcggagccgtcatctctgacagtcgtctgtttaaagaagttcgtgaaaagccattgatgggacgtgcgctcggagagagagcgaccgaccagaccgcttggaaaactgctttgcgccactatttaaccagcgcaggaatagctgaatacaatttcgtttctcagggaaatgtggttgtttatgaagatgggagtgaacgatacgtcagaaacttttcgggcagttatgggttcagaaagtcttggtttaagggaatgacggcggttcggccatcgccgctgaccaagcgcttgattccaaacgcaacactttagaagatcttgattccgttctttgacaactggatagcgtattcaggttcaagctgaaaagagcatctgtccggaaggaccactccgggttagggcagatccggcacttgggcctccttggtcttcggactctggaggaaacctttccggcgtgtcgaaagacaagatgtgagcctgttactaaattctttcaccctgaactactcaactgcgttgagactgatgaagcgctcccacgtgcgttagcgactgagtttcagccaccctgaacttctcaactgcgttgagacccaggaaaggggtgtaaagcaatccttgactactgtttcagccaccctgaacttctcaactgcgttgagacgctatccttatttcttctagtcattagccggagataagacaccatttccgcgaacctgtggtttggcgtgatggattgctttcagatcataatctccgggttgtctaagtatctgtaaacgccacggtatctcatcagcgtgtacctcccgggattctgcgttttcttctgcttcgcgaaataatctgctggaattaagaaaaaagaaatccgatattcaattgtgtaacag

SEQ ID NO: 122 - DNA, 11101 bp, synthetic construct
  misc_feature 1..11101: note = Synthetic
  source 1..11101: mol_type = other DNA
tccccgtgatgacaatggcagtgtagacgatattttttctactgccatgttcttctttgaagagcgagagaagcaggcctgcgatggcgaagaagttcagggggaacatgggttggatgagttccaaaccatgccggaattgtctgaaccagttgaggagaaatttcaaaggggaaagcataatcacgctaaagattgaaatatcatagggcaccctttgccagttgctcacccagttttgatccccgtatatcccgaaccagatatttttaccctgcgacatccagaacgggtttccggtagcgctcaagctcgtgtaaaggtgcggaaatgaagcaatgaaaaaaaagatgagatatactgtcgcttttttaagggatgagccttcttttcccttatgggtatagagtaaccagaagaacgttatgacaaccaggacgagcgactgataccggaccatgtaggcgagcccggcaaaaacgccagccatgataaaatcagaattcttttgctgttctttcatgatgtaatagacggagatgagctgaagggatagggcaagggtatcattcccttccagaaagaaccactggaggaacagggaagagaagagaaaaagctgggaaagaaaggcaagccgtctgtctttgaagagggccaggactatccggtaggtaaagagaagacaaatcacaccccctgtcagggagatgatccttgcagcgatgagataatcgttggagatgaagaagagtgtcttaagtaacaggggataaccaaggggaaatacaccgttgatccagttgggatagtcatgcaatgtgacgtagtagtctgcccaccatacataggtaaaaaaatcttcccagtggacaatgaggttactgaaactgatatatcctgcaatgatgagagatgcaacggggataatatagggcatcgtcgttatcatttcttcacccaaactgcttttttgtcaagatattttgtttgctctgatgttttgtttgctcctctaaaagggaaagtcccgcaatgaattctttctctccttgccctgagcatggaagtatcatattatttaagtagctatgagaactgattgaggagtcttatcatgggcattgcttccattaatcccgcaaccggagaagtcataaaaacatttacccatctgacagatagggaagttgagcataaacttgcactggcgcagaaggcttttgagcaatacaaaaacatacccatttgccaaagggcggagtggatgaaagaggctgctcagatccttgagagcaacagtaggcagttcgggaaactgatcaccctcgaaatgggtaagacatttgtttctgctgcaggtgaggtggaaaagtgtgctcttaactgccggttttatgctgaacgtgctgcagaattccttggagatgtccctgttgcaactgatgccgggaggagttttatccgttttcagcctctcggcgctgtccttgctgtcatgccctggaatttccccttctggcaggtgtttcgctttgccgcaccagctctcatggctggaaatgttattctcctcaagcatgcctcaaacgtgccgcagagtgctctcaccattgaagagattttccgggatgcaggattccctgaaggagtcttccagacactgctcataacggctgagaaagttaaagatgttcttgaagatgagcgtgtaaaggcagccacactcaccgggagcgagtcagccggtgcaagtctggcttcgattgcaggcagtaagattaagaagatggtactcgaactgggagggagcgacccattcattgtgctggaaagcgctgacatagccgaagcggtttcaactgctgttactgcccggatcatgaataatggtcagtcctgcgttgcagcaaaacgtttcattgtaatggaatcgattgctgatagatttggacaaaacctgaaggacaagtttgaagcactaaccgtaggtgatccgatgaatccggatactgacctcggaccgctggcaacgccggatattctgaaaacattagatcttcaggtccaggcgtgtgtacaaaagggggcaaaggtattgaccggtggtcaatccatgtctgattgtccagggaatttctacctgccgaccattttaactgatattccccctggtacacctgctgaccatgaggagttcttcgggcctgtggcgctcctctaccgggtcaaagatattgacgaggcgatcagctttgccaacaggacacccttcggtctgggcgcaagtgcctggacaaaagatgctgtagaaattgagcggctcgttcaggaactggaagccggtgctgtctttatcaacggcatggtcaggtcagacccgcgcctgccctttggcggcatcaagcactctggatatggaagagaactgggtatctacgggattcatgaatttgtgaatataaagacggtgtgggtgaaatagcaaaaaagcaatatacttgcaactggtttaggtttaatataaattaaaaaataatgacttaaattcaaataagcagatagggtatgttagcgaaacttaaaaaatattttagcgaaagaaaagatattgcatttgcttttttgtatggttctcaggcaaaaggaaacgctacaaaattatctgacgtggatattgctgtatacttttatccccggcaaaagcatcccgtggaatatgagtcaaaggttttttatgataatgaagataagatatggggagacctcgaacggattctaaaaaaggaggtggaactccttgtgctgaaccgggtttctgccagtgtagctgcaagtgcgattagggcgattcctcttgcgatcaatgattgggggatttatctcgattttatggaggttataacagatgaggctgaagattttatggaattagttatcaatgattataaagagaggataggatttgaaacgagaggctaaagtaaggcttattaaacatataacctttcttgaaaacgaacttctggattatgaacgattcaggtcattgtcatgggaagaatacgataaggaaagggataagagaagaaatgttgagagatggattgaaaatattgtgaattcgtcaatagatattgccaagataatcttagcctcagaagacagatcactccctgatacatacaaagaagttgtatctaacctttcacttgttactggtttcgagagtgaaactatggaaagtcttgctgaacgggttaaattgggaaacattatttcccatgaatatctggatataagatggaattctataaaaagatttactcaggaagcagagccgctgtataaaaacttcgtagtaatggttaaagagtatatcaaagaaaatatttaactgtcggggcggatatgcaggttcaaggtgcattgcccggagattataaagccgtctttgtattacaagcaaaggcggttattttgttttaggggggataatgagagctaaaacaccatgtgaaaacgaccccaattccctttctgtataagagatgattacccttggcattgattacggcgcctcatatatcggcgttgccctcgtggaaaacaccgggaccggcaacaggcctctcttcgccggcaccatcgccataaatgcccgcgatttgaaagatatggttgaaacacgggcaggcatcaggcgcctcaggcgaacgagaaagacaaaaatcagacgcctaatgaggctcagggaaagccttcttgcctgcggcataggcacggaccaggtcaccctcatcgtccgcttctgcaggaaaagaggttataaatctctttttgatgagggcgaaagcgaaacccgcgaaaaagagagcgacctcgcttaccggttttcccgtgaaaccttttttgaaagcctcgaaagggaactcggcctcatccttccggacaaccatctgaaacctcaagccctgtcagtctgtgagagggtcctcaaccggaagggagaccctttccaggaaatccgccttatcaggatagacaaccgtggagccagccggtgcgcctgggagggctgcagcagggttaccccgaggcgcgagaacgccctcactgatcccatcgcccagcaggtctataccacatgccaggaaaagataagagaaggtggagagcaggcaagggaaaaggttgacgatacggtcagtcagcttgccaccctcggcaagcgcatcaggaacgcctctggagaaggggcaaacaaagagaaaaaagtcctcaggaagaaagcgcgtatgctcctccgggagataaaggaactctattaccagccagccagggagaccctggatggtgagaaggcgtggaagtatattgagaccggcgtcctgaacatcatggagaagtcacaggggagaaaccgttactgtagagagcacagcgccgcctacgttaaaacagtcctcgcaaacgaggcaatccctttcaagcagaccatatcagagtcagacatcatctcgcggagagagcagattacctatcagaagctctggcgctatatagaggcacgggtgcttcccctcgccccctgcggcattgaccgcatcgtcgtcgagcgcaccgctatcgacctgcttgccggcagccgcaaaaagattctggatgcctcagaccaaaccaaagaggagatgtatcagcatggacccatgcacagattcgaaagcgtctcagaaatgctgcggaaagagttcaatgggctgtgtgcctactgcgggaagcaatcggattctctcatggagactgagcacatcctgccccgggcagagttcttcttcgatagctacctgaacatcgtgcctgcctgtccccggtgcaaccagagtaagggagcgcgcaccccctcggctgcttccctgaaaatcaacggcgaggcatacgaggcatatacgagctatctccagagcaattttcgcacgcgtcccctccaccttttccataccatcaagaagggcgtcctgaacctgatgcgcgaccctgaaaggcagtgggaggcggagcgttacctctccctcatcgccagccagttcgcccaggtcgttcagagccagcgcggaccacggcccttcgcacgctatctcttttcacgactgtcattacgtcaggtcagaaagcctgaaatcgtattcaaaagcggacggcacacagcgctctaccggaatatcgcctaccccgacttcagcaagtatgcagaaagggaagaagggggtgtagttaaccatgcagtagatgccatcctgcttgcgtccgacctgccagacccgaagcctctggaagcgctcggcttctctcccgctgatatgcgcaggttctgccgtgccgtcaggcagaaggccccggttgcaggtgatagcggcgtgcctgagcctcccgcccgcgacttctttgtagagggctttgaatctgttaaatccggctttgtagaagtgaggcttgatgccatgtgctggaacaagcgtgacagcatgacccacaagcaagacccctatggcctttctgagaaagtaaatcttcccaccaagcgggtgagcgcttttggcctctgcagcgaactggaaaagatgaaagatgaaaaaggagtgaaaaagaaagttgacctcattcatcaccctgccctgagaaggactttaggagacgccatcaacccggaaaaccccggcaaatcagcggcggaagcgctcagggcgtggctgagcgaatcggtgagaaagagcatccagacgtctgccttctccaacaaccccggagaccagcaacgcaaaaaggagcttgagcagttttcttcctctgatgagtcccttatcccggcggtaatcggcgtcaagatgttcgatatgggggtgagggggaagattgacctccagaggatagacccgcagaccggcaaaaccgggcaccgctacatgacccagcctgcaaaccgggcagtcatcctggcgtatccgaaaaagaaaacaggcatgacggatatgtccaagccctgcattgcccgggtgaggcagaactattcccttcttcctgagggaaaaggaatcttcaaggaacttccggagagattgaaggagggcataatactcggaaaagagaataccatcctggacggctggaacagtgaggttgagcattacctctcagtctgcggtttcagcagttatggcatgctcacggcgggatgcgttgtctgctacggagacggcaagaagtggtttctaaaaaatttcgatgaaagcaaggaattcagaaaggcgagactaaggaacgtcgttggtatcctgaggtcgcccttctccggaagaatgacgccattaaagcctttgacttaggattcataaggtggtaaccctttaccacattgttctttgacaatcaggaccggttatcagttccggttgaaaagagcatccgcctgagggcgcactccgggatggggcagtcccggccattgctgttcccctggcatggcaacatgctccgggagcaaaccttcaggcatgtcgaaagacaggatgtgagcctttttatcatcgagcacttgtttcaatcaagatgattctcaaacagtcattgcgacttggggtaaagggcaagttagggacgtgacgatgtttcaatcaagctgattctcaaacagtcattgcgaccttgaagatttatggaagatgatggaagagaggaagggtttcaatcaagatgattctcaaacagtcattgcgaccctgtaatctgtgcggatcaccccctatataagtttcaatcaagctgattctcaaacagtcattgcgacatatggagtttataattggcagaaaactgacaaggtttcaatcaagctgattctcaaacagtcattgcgacagccaaaaagctcttgatgttcaatatcgtatgggtttcaatcaagctgattctcaaacagtcattgcgactgcggttctgatttgtcaaagaaaagcgatgtgttagcagggtatttccgcgaaccccatccttcacgtccataatgtgaggaaaaagcagcaaagatacacctcatagaatattttcaaccctttgaataatggcagcatattgattttccgcgaaccccaaagacaaaagattcaggacgttctaaaataatcctctaagaaatagctaaaacaacgagtaaaagtttgataaaatgaaatcaatggaacaggccctttttatatccaaggttgatagcctgaaatattatgaagatacagacgaatttgcccgcctctatttcgggatggagttctgtgagagacttcttcccaacgtagatgatttgaagaatgtgatcaactttgtcaatgagaagaagataggcctcacgctggtcactccctatgttactgaggatggtctaaagagggtcgaaaggcttctcaatgtattgaatgagcaaaaacccggcagcgaggtggttttcaatgactggggtgtgtttcatttgttgagcgacaactatgcagggctggttcctgtgctcggaagactgttaaacaagatgaagcgcgggcctcggttaatgaatgtgctggacaagatcccggaggaaagcgtgagatattacaggagcccgggcattactgttccgaaggtaagagaatttctgcttaaaaatcggataaaccgggtggagtttgacaacctcctccaggggattgacttggagaggacaggggatgagatcaggaaatccctctacctgccttttgcttacatcaccactacccgcctctgcctgactgccttatgtgaccagccggacagggtgaaagaagtggggattctcccctgcggtcacgagtgccagcgatacactttctgcctgaagaaccccatcatgatcgctaacctcatccgcaaagggaatacaatttttctttgcaacgaagacatccctgataacttgagaatgtttgaccgggtagtgattgagcctgaaataccaatctgataaaggaaaccatgaaaatcctatcccccttggatagcaaggaagaagtagaagaattaatacaggccggagtcgatgagtttttctgcggcctcctcgaggagaagtggcatgagaagtacccggtcatctccatcaacaggagacctgcgggaaaggggcatttccggagctttgccgacctaaaagaagcggtcatgatggcacaagatcaccatgtacctgtttatttcacgatgaatgaacactactatattgatgagcagtatgacctggttattgattatgtaaaaaaggctgtagacgcaggtgttgcaggaattatcctcgccgattacggcctcctcaccattttgagcgatttgaacctgccggttaagctccagatcggtaccggaggaacggtcttcaattcccaggcggcaaagttttaccagaagacaggagcttcaggcataacccttccgcgccatctgaccattgaagaaatcaggaagattgtgcagaacagtccgggaatagagttcagcgtctttatcctcaactcccggtgcgtgaatgttgacggcttctgcacctttgaacacggcctctctgataaatcatttctccccctctaccggaatgcctgtatgcttccctatcatatttccctctatccacaggtcagcgctgaggagcgggatatgggcgagataatccgggaacaccgctttttggaacggcagcacatatgggagactgttcacgtagatgaccacccctgtggtgcttgtgccttgtacgagttcaaagagatcggtatccacgggatgaaggtggtgggacgcgggaatccccttgaacggaaggtcaaagatgtaatttttctgcggacacttctggaccggcttgagaaggagcgtccttccttgcctgagttcaggaattcggtaagggagctctatcagagcacctattcacgttcctgccgtactcacctctgttactatcctgaagtaagggaaactccggcataatattttcttgctgcctgtcacaattcatggtaaatttatttcgattatctaaccattataggataattatttagacgtctaaatatatctccagccatagggtcttatgaaagaggaaagggtaaaccatcaaaatcaactgcgcggaaggaggatggggatatacacagggagcggagcctctcattcctggatctggtttgttgatatccttgaaaaggcgggtgtcgacaacctcaccttcctgggagaagacgacatcaaaaaggatggtaacctgcaaacgttagatgtcctcctcctctcgggaggagataccttctcaatagctgaagggttaggcgtggagggctcagagaagatagaacggtttgttgcagaaggtggtatttattttggctcatgcgccggtgcctacctccccatgaggtcttcaaagtatcctttgaacctaatgaatcttgtcggggtaaaaatcagcaacctttcaagatcacttccccgtccgctcatacaatcagaaaagttttgtactccctatggatgcgactatgtctttcatcctgtccgtgatgaagtgaagatcaggtgcaccaacgtatacttccctgaagagcaatttgtagcaccgctctacggcggtccctgcatggaaccatcagaggatgcaacgccggtagcatattacagcgggtttaccgacaagacccttttccttgttgatgaagacctggccagggagacagtgcagggcaggatagcggtttgcagcaagacgataggcaggggaaaactctatctctcaggcccgcaccttgagcacccgcattatccgacagcgaaccggttcctcatggagatactctctgatggtctgagagaaagaaaggcctttttccataagcgtggtgagagtgaagagaggtcagagataccccgcgactccttcagaaaactgaaaggagagctgagcggcgcacggattatagccctcgctctggagagggagaccatgacctggctcatcgggaaaaaggtatatgagccggagaaatttcgtgtatttatcgatgcactctggagccgtatcaataacctggagaaaatctcttggaatggcctgagcagcgagacggttcacggcctcgcggcctctgcaagggaagtacgggaaaagctcaaagagctgaaaagtgaaatgcaggcctcaaccgataccacggggctcgtcgaagcaataataagggagttaaggactctcgcatctgcctttatgaatgtttacttcggtgtgaaacgaggagaaaacgtgcaggaggaaaaaagcaatgtacatgtattatgaagctcagtgggtcctttaccttttcacggtgattacgatagttatcttcttcatcggtgtctatgccaatatctacctcatgagaaagggcaaagcgaaaagcctcatgtacacattcagtatcggcactatgatgcaggcccttgtgtttaaggtgatactccagagcaagctttttcaacagagcatcctccgctggttcatgcacatattaatattctggggattcatgggacttcttgcgcatacggcttttcttgcctacttctcttatttcgtatcaccgaattcagccgtggcgcagttcttttttacgcccggctcagggggcagactcttcttggatttctggggagatttctggggggcactccttctggcagggtgcctgatagccatcttcaggcgctacataactaaaaccaagcagctggacaccatccttgcagattcggtcgcgatctggctcctcttcttcatcgctgcgacgggtttcttttgcgaagcagtgaggttagttcatctacccccttcagccgagtatgcatactcatttctgggctatcccctgagcaagattcttttactgtctgtgccgtcggattctctcaaggcgcttaaatatacggatcaggtgctcattcacctgtccataggactatttctcattatttacatacccttcagcaagatgtggcacatctttgt

SEQ ID NO: 123 - DNA, 20179 bp, synthetic construct
  misc_feature 1..20179: note = Synthetic
  source 1..20179: mol_type = other DNA
atattctccgtccattttttacacttctgcaatcaataaattgaaacattggcagcctaaattccgctattaataaatattgaactgtttttaaggacagaaatgccaatagaaaaagcgctaatatcgcaggcggcatctaaaatagcgatttccaaactgagggaaaaaatcgaaacggaagtcgtaaagggatgtacacccgacatatcccctcatcgaatagatttggaacctcaattctatccgctttggcaattgagagatgatatcaataataggaacctttggtgcaacaatgaagtatcttccataaaaccagatcattttatcaggctacaaatctggatctcgcccgatcaaaagcttgactggattcaatctgatcttttcttaaaacagcttaaaacaatcaagcatagagcgatttttgaggttcacggaaatagagataaaatagttatctctatgcaaacacataagaatgatattcctattgtaatagcggcttttgagagccaattcgatcaatgtgagctgacaccatttcaaactgggcccgggtgttctattttcaacagagcaaatatgatttctggatttagagactttttccctccacctccatattcgcatttattaactcgcccccaagaattaaaaactcccctttatcagctttaatctcagttatttctgccattgcccccccagcaaatggtttactgcaaacgattttccaaccggttcaaccaatgaataattggcaccgtaatgttgaaatacttttagatttggaatatattatgaagcttaatagcggatacaacccacctcagagatacgcgcagcaatccccctccggagacttacggcaaatggcatgggaggtagaaagtaaagcccataatgataaacctttttttgccatggcctttcgaattgtcgcgctcaacgcaggcgatacaaaaataccaatattagacgctatgtctacatatgcaaatttgtttcagcatggtggacgaccattgcgatatttaacagagaaggaatatttgaatgttctgtcaaaagatcaaatccacaacatgcttaaatttggtttcacttatcgtgctggttttctcgctaattccctagagctttccggctttgtgcacctcccatttattgatgttcaagaaaataaccctacaccattaagtctattggaaacgctctccatccgtagccctaaacttctatccggtacctggattggtaatatcgactatgccggaaagatacaaaagctttgcctgccagatgatgaacggcaaaggcataatcacttaatcggaaaaccgggtacaggaaaaagtacaacaatagaacatatgattttgagtgacattaaacagggccatggtgttgcggtcctggatccccatggcgacctaattgagcgtatgctttatctcattccagagcggtttatccataaaacaatctatttcaatccaggtgacccggactggattcctatatggaatccccttgaacgcattccaggtcaggatattggaagaacagccgacgatctcgtccaggccattcagagttttgtagcgagaaatggatggggagatcggttagaacatcttttgcgaaatatcattttttcaatgattcatctggggaatggtacgtttctcgatatttcaaacttgatgagaaataagtcagatgaaagtgaaatgcttcggaataaaattcttgaagtgattgataatgagacggtccgacaattttggatgcatgactataaaaaatacggcaaagatgatttcggcccgcccaagaacaagctcagcaaattgttagtttcagaaagcgtatctctgatgctctcttatcctgaaagccggtttaattttcgaacaattatggatgacagcatgatcttgcttgtcaacctttctaacttgggatccatggtgcgtgagatactcggttgtttcatactttcactattacacctcacggcattgagtcggagtagcatgcctgcgaatgaaaggaagcaatttcatatacactgtgatgaagcccaccggtttgtaacagattccttggaagatctcatcgcggaaacccgaaaatacaatgtgagtttgagtttggcccaccagtatatcagccaattcggtcaaaaaaaaaccgatgccatttcgagtgttgggtcaacaattatcttcaacctggacagcaaagatgctggctacatgatcaaagatcttcaaaaaaaagtaaaagtagaggatattgttgccctcagaaagtacgaggcaattggtcgtataggaactgaaatcgtgaggtttaaaacacgtccaccagcacctaaccctatcaatcatttcaaacagcaaattatcacagaatcacgaaacagatattatttacccaaacataaagtcaaagaatatgttcagagtcgtagcaaaagatggcatgaaccatacaggctattaacaacaccaaggtatgatagcactggaaacattgaggaatttgaatatgacgaatttgaatgatagaatcgatgcaacctccatccttgatgacgtttttcagcatatggaagaatcacatcttcaacaaacaatagatataccgattaaaatgacggctgccggatttgattcatacgaaaatgaggaaattacctttcaatcttatgtgtgcattattggtgcctttataaagaaactttatcagctaaaaattttttgtaatcaaaatttatctgatgaacaggcacaatcggaagcggtggtcatactggatcggttttatccaaatatgaataatgatggattgatgagcgcatacttagatacccttaatgccgaattggatgggaataaattcattattgcgcagttggcaaacatcctaactcaaatagcgagagaaaaatatgtaaaatggattttctcaagcaagatccattcacttgattggtctacaaaatgtgacatcaccgaagccgtccttgcacaaaatgatcgtcacctgacggcagatattaaaaattgtcctcctgggatacttgttgccgaactttccgatctaattcaagcagctttagcctcagaatttaatgtcaaagaattccccgccagccaattattcacatctgacgtgcaaaaaaatgatgcgattgaaacgtcaaatcacattctgctgctttccttgttgaatgacttcatagaataattcagctcgaaaatataaaatgcgctatcagaatcgtgaaaaaataagaattttccgacgcctgttccatggcttgacgcatgtttatgggtcccatgacattcaaacgggtcgatcttaccagataaaaaagccagtcaccgacaaggtaattttaaatcatctgctgggaaaaaggccatacggtgtctaccttctcgtgaaggataaaatcagggcaattgcatctgattttgacttacagaatcgtttggcgccaatggagtttgtttcttccgccaaacactatggcctggatgcatatattgaaaggagcaagtcaaaaggatatcatgtgtggattttctttgaaaatggaggcgttcttgcacgtaaagcacgactcgtcgttcgtcacatcttggaagaaattgaacatatagaaactgagatctttccaaaacaagaccaaatagatgaaagtgaatgtttcggaaattttattaacgcacccttatttggatctttggttccaaaaggaaggactgtttttataaatccgacaacatttaagccatatacagatcaatgggattttttaaaatcagtcagccggtataatgaacaagttttggatgatatcactgagctaaacaatttagatcaacaagaatacgacaatctgccaattaataaaaatgtgggacataccctattatattttgggttacctatatgcgcccaaaaaatcatccaaaatggggttacacgattccaacgagatagtgctttcaggcttgccgttcatttgaaaagaattgggtttcctatcgatgtcaatattgctgtactattagcttggtcaaaaaaaaatcaacccgaaaataataaacgcgtcataaccgagaaagagatcatcaagcagacagaatatgtctatcataaaagctatcgaggatacggttgccaatcagaggcagttagacatttttgtgacatcaagtgcccattaaacaaaatgtaaaggaaatgcattcagcaacatgtttccaaatgaatccagtgttgacagaaaccttgcttcctgtttacttactccagaggaggccgcccagttttttcggaaaagtttaagttgggtatataaaaactggaaggaattgggtggtaggaagctcgggggttctctgttcttcccgcgaaaggaggacctatatgagcgcatttttagtaaaaggaaaggggtggagatacgacttcactctgaagggaaccaggtatacgggaacctggttcaaaaccaaacgagaggcgaaacaagccgaatccataagaagggaggagataacaaacccaattccagtgaaaaagacgatcccaaccgacatgggcttcttgacgttagccaacaaacgtcttgattacgttagccgatatgacacctatgaacattaccgtcatactttgtatcatgtcaaacgatgggtaaacaaatggggccatatgaaatgtagcgaagtttctggagatttggtcgaagcttttattcttacacgttctgaggtctcagcctacacggcaaataaggatctacgatatcttcggtcgcttttcaactttggaataaagcgaaaatggatcatagaaaatcctgcttccgatgttgattttcttccagaagaaaaaaaacggaaatatttaccgcccaaagaagatgttctaaaggtcatttccgttgccgatcctgatactcaagattatctctggaccttagttttgacagccgccagaatgggtgaagtcaactcgcttacatggggtgatgttaatttaaaagatcgatatatcactctttggacgcgaaaaagaaaaggcggcaatcgagaacccagagacgttccaatggttgccaagctatatcagatcctctcttatcgttacgttaatcgtgatcgtaataaaccttgggtcttctggcatacctattggagccgcaaacgaaagaaatttataactggaccatatgccgatcgtaagaaaatcatgaattccttatgtaaaaaagccgatgttaaatatttcagattccatccattccggcattttactgcatcaattcttgatgatttgggcgtaccgattggtgttattcagcgaatcttaggacatcaaaaccgtaaaacaacggaaggctatctgcattcaatcggggaagctgaacgacgtgcgatggataggttggaaaaagtagatatcttttcaacagatttaaacaggaagaatgattggcaaacaaatgtccataaggaattttggcagcgaaaagtgaaaaggcccaaatatgttattcttaaaaaggacatcaaaaaattgggatatgttggtactgggaaaaaatacggtgtcagtgacaatgctgtacggaaatggctaaaatattttgaaaaaggtttaaattacgatgttgaatgtatttcagtataaagaagaaatagtttttctcacacgattctcacacagccgaagcgtcacagaaaaaaggggcacccaatattttggataaccccttattttctttcaggaaaaatggtgccgagggacagaatcgaactgccgacacggggattttcagtccctttttatagtgttttcaataccttcccatatcatcacaaatcgtaacaaagtccttgacatcattcattattcatgttacctttacagtcatgaataatcacacgccaacacagaacataaaccgaaaacatggacagaacatggacaggaggcccctctccaaatcttggaggtgggggcctttctgctggggaacgggtacccaccataaaattttttgtcagactttgctaataattccgataatatgggaggtgtagcatgccagggaaggttgttaaatatccaggagtccgcagaaggaccagaaaaaatagaggcgttgacgatgtctatttttcaatcttttatccagtggacaagctggacaaagacggaaaccctgtccttgatcaagacggcaacgttgtccgcaagcccaaggaggaaggtctgggctgggcctccagtggatggacagggaaaaaggctttcaaggagcgtgaaaaactcatggatgccgccaagcgcgccaccggggaacctgtcacccttgaagcaaaacggaacctaaaacgtaagaaggacacagaggcccgagaaaaggcagaggcagagcaaaagaaattaattacctttgccgacttttgggaaaagcattactggcctgataggcagaagtcaggccgaagtccggaaaccatccgcaaggaaaaagagcatttcaataactggttgaatccagccataggccaccttcccctcaaaaacattgttaagctgaatgttcagaaggtccagcacaacctcacaaaagctggacgtagtccccgaactgtccagtttgttttcaacaccttccgtcaatgttgggagtatgccagggacatgggcattgttaccacgaaatcacccaccaaggacaaggctttcaagtatgtctccaggttcgacaatcagagaatccgttttctctcctacaccgaggccgaggaactactgacacgcctcaagtccaggtccatcattacatatcagcttgcccttttatccctggacactggcatgcgtgccggggaaatgttcaaactgcaatggcagaacgttgaccttgaccggggaaccattgctatccatagcagtacaaccaaatctaaaaagacacgccatgtcagaatgaccgcccgagtcaaggcaatgctgacagaaatcggcaaggggaaatatggtcagcttgtctttatggatgaagatggaaaccagttggaaaagatcagcaacaccttcccaaagaccgttgacgatatgaaactgaacgaaggcattgacaaaaaggacagggccaaccggattgtttttcattcactcaggcacacacacgcaagctggcatgccatgaacggaacctccatgcgaaccttgcaagaactattaggacactccagccttgtaatgacgcagaggtatagccacctgtcacccgaacacctggaggttgcctccgtgaattttgaaaatgcacttaaccaaaaagtagtagaactcaggagcaaggaaaatgccaacagctaattgggaaaaatggttggacattgactacaaagacttgtcaattgaccagtgggcatgggagtttgtcagacgcaaccctgactatatccaggaatataaaaagttcaagccccaggaaaccattgccaatgttggggatgcccgacactggggcttgaagcgtggttatatccctcccaccactgacagccacccacggattgaattctatcggtcctatggtgatttactaccagacggacaccctgtccctcctggaaaagtcgcaattagctttgatttgtccatgccaaacaagccccagattgaatatgccaccaagctgttgaaggaatgcagaaaggccccgaaattcgtcaatagatgtgtaaatggcgagcttcttgacgaaataagtgtgccacagaccaatattcaacgtgataatttgccgtattatctcgccacgtgggatgccagaaaaagtaacttttccaatgccaagatcgccaaggctgtatatccgcacgccttcaaaacggacccaccaaatgccaaacaacgtattcaaacgttttacgataccgcaaagaagtttatcctcgataagcaatatgctaacctcttgatccgcccatagatcacaccattgacaatggttccgctggtagtcagaattttacttataaatcaatatataattatttgattgttaacacaggagtttctacgagtggtaggattaatgggtcaaatccgattctagaggttagagcataaacttgttctctgagatatggatgtaaaatatatggtgcattgttttttgcccaatgttcaatatgctttattggaaatttttcttcatctacacaaaattcaccaactaattcaaccctcatcgaaaatggagaattactatccttctctaagcctatctcaatttttatagcaatatttattctcttactttctacatcatattcgctatatccacttagtagattgatctcagtagcttctggcttctcatcttcattaggtatttgattagagcgaatgaataattcaagaattgtaatcttttcaagttgtatgccgtataattttgtaaaactgttgtttttatctaggttattcataatatcatgcagccgttttatatgaaaaagaacgaggagtagtatttactttgctaaattgaatttgccgtttagtacttcttttcactccttcaactttgcactcctttgattgccagatagacaagtgatcatcgtgtgttgaagtgtattcaacaaatgctctcttaatactctttaaatagtcttgatcaaattctaatataagttgtttacttaattcatagtcgatccattcttttgcaatatctactataaattttttgcttaaagccccagactctaatagagcggttgcaatatcgccttttttatgtttttccagttcgccccttaattcctcttcagtcattgacataatttcttcaaagaccttttgtgaggcatctctaattttatccattgttaaacctctatttgcaactttttaatgcaatcggtatctcgaactaaatagcaataaggatcccctaatatgagtattggataatattcacaatacttcatttgtggcggtgaaaccctcatttctataatttgatatttttgattattttgggcttccaacctattaataaaaagatcatatgtcgctgcaagatattccaaccggtttggtatctttttatttgctatgattattgcaatttgattttttaactcatgagtttcgatgttaagatactcatcatcattaacttcaaagaatccaatgatcaatgcaaagtttgtgttgttatcacctatataacgacctcgatcattgctgtatctccaccatgattctgctaaatcttttgcatgatagctatcacaccaaaaatagactcctgttcctctacgcccaattctacctttaaacccttccctgcttatcttctcagtcctagcaattgtggttccgtgagttccagaaagttttttcatgaatacatagaaagttatcggcgtgattttttattttttacttaaataattataactgttttcgttagcacctcaggattttattgtcaaacttaatttttgttgccattaaaagatattgtactaagaaactattgttttatatgatatttttcattgcgaattaatttttcctctaaaattcgcaattatcatatcgaataaagtatcgagggcttgaatatatcaaaagcggtgacaacatagatggatactctgccattacaatgtgtttcccatgttcctcaccaactttataagcttgtcctcaattatatcttgtggttccaaagttacaaaaatttgacaatacactaaaaaaggtctaagaaatactaatctctagatttccccgacgattaatctaaaaatagcgttccataatgtatttattttaggaaatagattgtggacaaacaatattcaataggaattgatttcggctcaaaccatattggtttggcacttgtttgccattcagatggatcaaaccaacccaaatttgcaggtacccttcactacagcccagcacaactgaaaaagaaattaagcccccgaccgcaattaagacgaatacgccgatcaagaaaatcaaagcattccaggctaaaaaggttatccaatgctttacgtgccctcaatcttgatgaatcacagatcaataagatggttatcttctgtcgtcggcgagggtggaaatcattgtttggtgaatctaaaattgaagacaaccaagacagcgacgaacttgtattcaggtatttccgtgaagatttttttcttgctttagaaaatgaaattcaatccttcatcccgccagataaacagtccaaggtaatatccatatgtgagaggattttaaatcgccctggaaaccctcataatgaagttagaaaactaagaatagataaccgcggtgtttcacggtgtgcctggaaagattgccagcaaattactcccagacgccataatgcgattaaggatgcattggcccagtttgtttatttgattattgatattgagcaggttagaacggatgatagcttaaaagataaaatcgatgccgcactagatcatcttgaagagttgggcaaacgactttgcagtgccaaggttgctaatcacccacctgaaagacatgatgccatcaaagcagagcgaaaggtgttgctgaaaaagattcgacaagaatcagctttgataaaagagttggccaatcctgatacatggtcaaccaattacgcaaacattaaaaatatccttgaaaatagcggtggcagaaatcgatattgccggcatcacagcaatgaatttgtgaattttcagcttgctggaaaagccataccattcaaaaacacattattggatagagatttaatatcacgccgggaacaggtccttttccaaagaatatggcggtatattgaagcccgccttttgcccctggcggatgcaccgatcacaagacttgtggttgaaagggttgccattgatttgcttgctggaagttggaagcagatccagaaaacgggtgccgctacacttgaagatatgtatcagaatggccccaggaaaggttttagtagtaccctggtaatgttgaaggaagaatttggcgggctttgtgcgtattgcggtatagaacataccagcatattggaacgtgagcacatattgccgaaagcggattttgtttttgacagctatctgaatcttgtgccatcgtgtccggagtgcaacagacaattgaaaggtggccgagcactaaccgccgcacgcttgaccatacacgcggatgcatacgatgcttatcagaaatacctagccagtaagttcaggaacaaacccttacaccaccttcatgccatcaaaaaaggtatcctgaaactgatgacagaagaaaaacgaacctgggaggcagaacaatatctcgcactggttgccaagaatttttcagaaacaacaggatcccaaagaagcccacggccgctggcacgctatctatctgaaaaactaaaatcaaagtttggtgtatttccaaagatagattttattgcaggaaggcatacatctctctggcgacaagtcgcatttcctgaatttgacaaagcggaagataaaacaggcgacaattccataaatcatggcctggatgctataattctggcttgtaaattaccaaaaccaaatcttctggagggtgccaatctgccggtaaggcatatcaaatcatgggttgaaagtgttaagaaagccgcccctgaacctggagacaagggtattccgaccataccttcagttgagtttgttgtgccaggatttgaagatgtttatcaaggaaattacatcagcgttgatatggccaagtttaactggaaccgtcgtgattcaagtgttcagagacagggtatcttcggttggaatgagcatgtcaacatgccaactatgcgaaaggctgcgtcggcacttgccgcagaattgatcgaagcggataagtcagagacaaagattaataagattattaataacattctgcatccgcagttgaaggtggccttaacagaatgttgggaaaaagaacaaaccggtatcgcctgtgcaaatgctttaacggaatggacacgtaaatctattggtggatcgataaaaacggcgtccttttcaaatcatccagcagatcaaagcagaaaacagctattgcaggattttgcagacaaaaaaactgatagtattcctgtaacaattgggattaaaacgtttcgtccttccgatacaaaggcagttaatctattccgagttaatagtgggaatcatataatccataggtatcggtcagatcctggagttgttgcaaagattgcagcctatccgaaaaattgtgcccatgttgaccgaagaaagctgattgattttgattggcgacacaattgggctgtcatacccaaaaagagccgaataccacagccagatgatgacattttgctaggacgggcatatggacaacctatcccagacgaaagactatggttaaaagccctcgagacatattttacaaatatcggcattgttgaatatgcatttgtgcgtcagggatgtgttgcagtatatgaggatgaaacccaacagttcataaggaatttttcatcaacacagggatttaaaacaaagtttcttaaaggaattatcggcataaaaagaacgccgtttattgacaaaataacgatgaaccgtgtaatagacagaagaataacccccgctctttgacaaattggtagcagtaaaatttatggtttaaagttgaaaagagcatcctgcaagaaaggtgcactccgggtttcgggcagatccggctcttgccaccttcttgggtttacctctgaaggaagccttcttgcgtgccttttggcaggatgtgagcccttatttcgtgccaacgcctacgcacgaagtgcgactatcaaggcccatgcaaacatcattgttacaaactatttcaaccaacgcctacgcacgaagtgcgacccatgagggtgtttgcatacaacgcacccatgaatttcaaccaacgcctacgcacgaagtgcgacttaaagagcagttgttatgccatgctcggggcgtatttcaaccaacgcctacgcacgaagtgcgactgcacggtgttagtgtgtatgggcccccgaagttatttcaaccaacgcctacgcacgaagtgcgacgcggcgaaccagtccctcatcttttggtcaagagcatttcaaccaacgcctacgcacgaagtgcgaccttataaatatcaatgtcaagtaaaaaatgcaaaaatttcaaccaacgcctacgcacgaagtgcgacaatcaaaagcggtatctgatgggtataaacgaattatttcaaccaacgcctacgcacgaagtgcgacttcattcaacaggtgcttgcgcaactcgaccatcacatttcaaccaacgcctacgcacgaagtgcgactgcgcctgtcctgctggaacgacatcacattaaatttcaaccaacgcctacgcacgaagtgcgactgctaccaatttaacatatcgttataatatcgaaattaggcctgtttgtgcgaaccttcttggtttgaatgagcaggcctaactgcgtttaatctcaattaaataaatacaaaattaaacaataggttatatttattgcgaacctccttgggattttatgtatgattagggttcgcgcttttactgaaattgccacttttcagttaaatatcttattgatttctaaatcttcgattctccattcaaaaaatatcctaaccttccattcctgctattgcccctccaattacgtcatctcttgatcgttgatgataaggaaagtcagacccccgcactatcgttatatcccgccttacctccgtgtgatttcataggaaacatgaacgatcacacggaggaaatcatgtttgattttggaaaattcgcagaaagttggcaggccccggttgtcgcacgcagtcagattgacaagttcagtggaggccttctccatcccttgacattgcggaacctggattcattgggccagggaccgccacggatcaagctgggccgcaaggtggcctatcccgtggacacccttgtcaaatggatggaaacccgggccaacggaaaggatgggaaggatgggaaaaatgacaaagctaagagtgtgtgaaaaggattgcgttttttgtctatcggaatgtccagcttgcgggtcaatgaatgtcgatgtgcggttttcataccattgggaatattcaaaccagaccatgaatgaactcgacataaacgctacccatttctctgcaaccatgcgttgtaatgattgtggaaaagaaatggaggtcgatgatttggcttctaaactagatcgccacttcaatctgccttttcaagtaaaaattaccattaacgataaaggaagaactcacactgaaaaatatgaggtttaatcatgccgtgtctatgctgtaactgcgaggaaaaaggctatcaaccggacacccgggaagtggactacgtttgtagcacctgcgtcaccatcctgtccaaggccagccctgccctggtcaaccaggcttatgaaaaggcagtggccaaggggttggacaggaaggccaccgcattatcaatgtttattcaaccaatggaggaaaaacaaaatgaccgaacaaaacaccgtaatcttcaaaggcctggtgacggaaaccgaggtcgtgagttttttaggtctgacaaaaggacaactgcaagaactcaggctcaaacacggattgccctttgtgaaaatcaacaggaactgccgcctgtatttcgaaaatgacattattgagttctgcaaggggcagagaacggttttaaaccaggctgaaaacgattcttaacgattaccatggacgtagggacacgtccatggacgtagggacacgacaaattttaagggaatggtattgcaagggtcaaccaaaaaaggaggaaaatcatgaagacactacgtagctgtattatcaatgattggcacaacccaaaactatacgataaggccgaggcgctcgagtatctgaatgtctctgataccgagtttgaaacccagtggcaagagaacggatgggaacatatccaacagcatgacggcgttctgttttgggaagacgacctgcgtttaatgcatggacgtatgtggggaaaagtataaggagggacaaaaaatggctaatgaatttaaactgccggcaggcgactgttccaaggaattcgcaaggttcgctgataaaaatgaaatgacactggacgaggccgcgaagtgggccgaagaccacgacgtcaaattattccggatttatcatggctccgagtttgtatgggcgagcgtgaacaaggatccgttgaaggaggcgctggcgctgaggcccaggcgctgaaagaggtcatcccccgggatctgtttggccgcagatgaaacggctgggaccctgcccagccacccgggttcaccacagggaggtgtgcattatggcagaagaaaaaaagagtaaaacatattttaaatgggcgaaaaagtattacgaaaaacgtggcaggccggggcatgagatcaaggaaaccccacgggagaggcagcagaaccgtaaaaagtggctcaagacgctcagcaaggaggagcgtgaggcagagctaaaaaaggaagaaagatggcaaagaagttggaatgcggaattttacggcatgactccgcgtgagttctcaaaggtaagcaggtactggatcaagtcgcacaactggagcatatcgaaggacggttatttttatgatcatatttcaaaacttggctacttccggccgtacagcagcgcccacgagttcgccattatcccaatggaggtcttcgccatggtcggcgcacaagcggcagcagtctacggcattttgcggtataaatgttacaagggccacgttgctttgatcaccagggaggaaatcgcagaaaagatgtgcagcaacgttaagaccgttgggaggatgattcaaaaattgaaagatgtgcagcttgtcaaggaagtgcgatgcaggaatcggagagcgtatctgttccttttacaccccgatttgaaaatgaaaccgggcatgtttctaatcccggtagtcgaggaaagccaacaataacaggagtctacatacaaaatggtcaaaatatctaataattgtcgggtagttacggctgaaaatgccaaaaacaacaagacattttgtcctgtactacaagacattttgtcctgttccaacaagacattttgtcctgtactacaagacattttgtcctgttcttatataataaaggagataggagtaaaaacaaagaagagtatttcaagagaaatactatacgttttcgcgctgcgcttcgcttgcccaaaaaacgtctttgatcgcttcgctttttttggacaacattacaccccttgcccaaggaccccaggtccatccctgcaccagaaatataatcacaccttgccccactatggaggtgtcgtcaaaaatgacgacaataactccgacaagtctaaaaacaaaaacaaaccggttaataagatcggtcccacaccttgcccccacaaaggaggtgtcgcttgaacgataaaacaggatttgaccgaatttacaagattgacccgaccacgatccgatgtcccgggctgctgaaatttatcgcgggaaaattaagatatttcgaccattctggaaataaagcccatgaaaataagaaaaccaaaaccatgaaaccaacatcacccaggaggatgcccgaaaatcagattcaaccataggatagagacaataaacagaaatgttacaaatttgtaattttttatgatgaacgcagtttaaaggtggacgtttgatgacgcccacggaatatgaaacttaggaggtactaaaatggatattcttgacgatttacgaattacaatctccaaactttcgaagaaattgagggccgatgacacggcacccgttgaaccggcacagtacgattcacttacaaaactgacgactgcttacactgctttgcttcgacagatgggcggcggcgacgatgacaacggcaccggcaacctcagcggcaggtcggcagaggccgaggcgatgcttcagaaaatgcgcaggagggcagacaatgactgacaaaaacaaaaacgatgccttggaaaaggaaaacatcatgattgccaaaaaccttgcgtctttggcggacatcggccccgaggaacataaattatcaaatgatgataaatctatagtcgatgacttattgtcattggtaggaagggaggttgcgtagtggacaccattgaaaaattaaaaaacaagatagtcctggttaataatcagatcaaagaccacaaacaggccttacaagatgccagggacaagctgaaacggttgcttgagcagaaccttgaaaagtcccgacagccgcagtccattcctaattccaggcgtgcggttgaattgtcggaaaagcgcattgttgagttgaccgcccttaagaaggacctgagcgaacgccttgaggtgcagaaacgtcttgtctatagagatcgtatgcgcacagaggccagaaacatcggcgaaagcctggaggcgtatcagggcctgcttacggccctcgaaaaggctgggcaggcgcatacggacgccttgtcacgggtcacacgatacgtttcatcgctgaccagggccgcagactttgccgaatctttagacaaagaagtcctgccgcttaaagatagcggcttggatcttggaagtcatcttcctgctttggcacaggctggttcacgtgcgtttgaattccagattgaccagaatgaaatcgaaatcattcgggccaccatgcagagcaattttaatagattgcagtcgataagcatgggcaggagaggatactcagtggtcaagccacgcctccagcgtcagcatacggatccgatcaaggcagagcagatggatagcgtaaggtacaatcagatgcagacagcgaagtacaaaagcagatagagagtttggcaggcggttttccttcagttttccgcctgtcaatagggggcttatccacccccacacttgggaccagggactgaccacctctggtcccattttatttttatttcctgctggacacaaaatcccaaaccattgaaaagatcagtcattttaatatcaatcaaaataccagatatttgcctgttgaaatctgaaatcatggacagaacatggacagggaaaccccagaacgaaacaagggcttatgacctatgccataaacccttgattttgctggtgccgagggacagaatcgaactgccgacacggggattttcagtcccctgctctaccgactgagctacctcggcattcctgaaagcagcaactgtatctaatagacggtgaattggttgtcaagataattttaactcaattttgtatgaaaaaagtaaagaactacggcttcattcttggatgccgagcctgtgaaagcctccaactcgttcaagatccaggcattagctcccgcccatatcgccaaaacaatactgcatcaatacggctgccgcgactgcagcggtttcagctttgagtattcgtggccccagcgacatggtcacaaaccccagggatgttgccaaatcgacttccctggcagaaaatcctccctcgggcccgaccaccaccatgaggcttcttatctgatcctcaaatccaggcctggatgcaacagccgaccctgattcgcattcccagaatatgattttacggtcacaggactcaccctgcgtcatcacctcttccatggacacgggtgggaggacttccatgaaattatcccggccgcactgtttaagcgcctcccggctgatcttgttccaccgcgccactcttgcggtcaggcgcttttggtccggtgttggcactgatctttccgaaaaaaaagggacccaccgggatataccgagctccgtggcctgcctgatcaaagtatccatttttttgcttttgagcatggcctgggcaaaggtaatctgaatatgggactctcttttagacgcatgggctttttcgaccatgacagataccgcgtcaggggatactgaccgaatacggcacgcaaaagcatgtccccttccgtcaaagacagcgatgacatcgtcactcttcaggcgcagcactttggatatgtgcatggcatccgaaccgctgataacagcagatttaccaaccttgagttcctggggggaaaagaatcgtctcataaattttcacatttgttttcaaatcaacgtttcgactatccaatgggatctacttagcatgcttgccaatatgccgtcgagtgtgaaaatttatacgtattagaaacatgttcggtcacggatgatgcttggtaactctgcctaatttaaaacaactactggtttaaaaaaggctgactgtttctaatacaacttgatgaaaaatcttaatatattgacatgatagctactatatggtattgattttccattaatctctatgctgtgttcatcactcgaaatcaggtaaaacacgtactttatattcctgtggtcacttctgattcctgtaaacgggggctgatatggaaaagagcaacgatccttttgataaaaaatcggaaaaggataaagaaatcatcgaccttaaagatgaattgccttcatcggagggtaaagatgatattatcgatctttccgacactgtcgactcgtcagccctggattcagacgatgacattctggacctcaccgaacctgtttccgaggatgcctcagatgaagatgaggtacttgatctattagatgccgtcgagcctgaagcagatcaggaagcggtccttgacctcacagagccaattgcccaggaaacccctgacgaggatgacatactcgatcttttagatgcggtcgagcctgaagcagatcaggaagcggtccttgatctcacagagccaattgcccaggacccccctggcgaggatgatgtgctggatcttatggatgccgtcgagcctgaagcagatcaggaagcggtgcttgacctcacca

SEQ ID NO: 124 - DNA, 6676 bp, synthetic construct
  misc_feature 1..6676: note = Synthetic
  source 1..6676: mol_type = other DNA
aaaggtcaacatcaactgtcttgtctgccacaataaaatggcagtcacgcatcagtggcgggacggaaaacctgagaagaacaccgtctatggcacaaaagacggctctcacatggataagatatacaaaaaccggaagaagagcgccacaatgacggcatccgttatgtgcgggcagtgccatcaggggccgcttattgacaggccggtaacaacccagtgttcaacgctctatggaagctatttcaatgcatacttgcctgcaggcggagacaagacctgtcaggaatgccacatgaaggaagtggacgggcactctatgttcagcttcagagaccggaactataatgaccctgcaatggttaaaagggcccttgatgtagaggttgacgtgaagaagggttacaaatccattgaacttcctaaactgcctccgtcggcaaaggttatcgtaaagataacgaataacgcaggccatagaatacctgacggctgaccttccccgaagagagtggtcctggatgtgaccgcaaagacaaaagacgggaaagaggtatttaaatccgaaaagatatacatgcttcacgcaggcgacagccgcaatgagggcgaccagatggtttacggccctgcaaataagctaagcttccttgaagaaaatacattccagccgctccagacaaagatggaaacctatgaggtaaagtttcctgaaaacgtcaaaaatctggatgtgaatgttgagctcagattccagtacggccctgaggtggggactatcggcaaggatagctgggttctctacaaaacaacaaaagaagcaagcattaagtagatgttatgtgtgtccggtatgtgcttgcacatgccggacacatctctcaccgccacggctcaatgataacttttatggattctttgccttccgcgacaagcttaaaaccaagctgcgcctcagacatgggaagtttgtgcgtaatcatatccttaacattcacccttccggccttgataaattctatggcagtttcaaggtcagaaggcgctgccccgtatgatgtcaccatctttatctcattgcgccaaaaatcattgattggaacggatacattaattccgggctcaggcaccgcgaaaaataaaatcctgccgcccttatcaacggattgaagcgcctgctcaatcgcgggcatcgcgcctgtgcatacaatcacgcagtccgcaagccttccgtcatttaattccctaatgcgctttggaacatcttctttggcattgattacattgtctgccccgaatttctgagcggcattcaagcggtattcatttatgtcagtcgcgataatcctttccgctcctactgcctttgccagattgatatgaagcagccctgaaatcccgcttcccatcacaaggacgctttgccctgcctttagatttgcaaccctctggccgcgaaggacgcacgccagaggctctatgaacgtgccctcttcgtaagacatattttcaggaaggatataaactccgctcttaacatttatctcaggaacgcggagatattcggcgaaacctccagggtcgtaattagttttgtgaagtgtttcgcacgcagtatgatagccgctcaaacagtagcggcatgtattacagggaacatggtgggacacgaaaaccctgtcgccgattttataattctttacgccttcgccgacctcaacaatctctcctgtgatctcatggccgagaactcgcggggccttttttatacgataccattccatcacatcgcttccgcagatgccgcttgccatgaccttgacgagaagctcacccttccctatctttgggacaggcctctcctcaacacggacgtcgttattcctgtaatacatcgcaactttcatagagaataatataacatacgctgagcttaaaaatttattgcaaaaaaatgaaggctatgccatatttaagacagttatttaaagaaatgaaaaccataaagaataagccccgcagagcagttcctgcaaacccatctttgcgaccgtttaaagaggcatgggacgatatagaaacctcccttagaaaaataaaacctcattttaaaagtgtcaaagaggcaatggcgcaggcaagaagaagaccttcttcgtaattaggagaagctaatggagaaaaaagaacttgtattaggtattgattacggcgggaaatacaccggcattgcaatggttgaccgcaggaataatcaagtgttgtaaagatggctatgatgtcaaaagaatcttataccctcggcattgattttggaagccagaatattggcatagcccttcttcgccacaccgatcaaaagcccaacgaaccgatatatgccggaacgcttcgggttgatactggtgggcaagagggacttcctactaaagtaaatgaccgtaaaactgcaaggaggatgcgaaggacgcagtccaccaagaaaaggcggttaaggcttttaagggattccttgaactctcttggcatcgatgaagatgcgataaattctattatctctttttcaagaaggagaggttattcatgggtcaaaaatgatgaaggtggttatagaaataaaaataaaaaagaagatgaatattttcaatttggagtaagcagaaaagacagctttttacctgcacttcaaatagagatagaaaaatgcttacccgaagaaaagagagaacaggtttttcagatatgcaaaaacattctcgataaagaaccggacgatgacattagacctgttcgttttgataacagaaatccaagtaagtgcagatgggacgatggggaaggtggctgcaataataatgttccagcagcaaaaaatgctgttgacatgcggctcaatcaatctctttatataaaaactattcctgtttttgattcactgaatgagaataagaggcaagatttttgcaggaaccttgattcctacatttcaagatttgccgaatttgcgtataaatatcaaaaagcatttaaaacggaagatactggcgtgcttgatgcattgaaaaagcaatattcaaataaaggcgataagtttaaaaaactatgtggaagctgccgacaagttaaagaatgttatctgaaaaagagaattgattttaaagattttcttttcgatatcgaaaaattttccgggaaaaacttcaatatgaaggaaaactttaacggctattatcacaaagagattgataatattgtattgaacagtcaatcgggcagattaagtttttgcagagaacattccgatgtttatatccaatacatgctatctcacaaagatattccttataagcagactattgaagaaaaagacataaaatcccgtcagcagcagatacttttcggcaagatatggcggtttgttgaggcaaggcttcttcccctcacaaacgggaaaatagatagaatagctgttgaaagaaacgcctttgaccttctggcaattccttttgaagacaagacgaaactaagtgagagaaaggtaaatgagctttactggcatggcccccaatatggttataagagtacaaaggaaatgctctttaaagaatttgatggcaactgctgttattgcccgaacaaattccctgaaagtgagtttgtagaggttgagcatattctaccgagatcaaaatttcgttttgacaattattttaatttagcgcttgcctgcaaaagctgtaacgctctaaaaggcaataagaccgggcttgaattcaagcctattcatccaaatgcatataaggcttactctaaatatgttgatgcccgagaaggacagaacttaaaacatatatttcatactatcaagaaaggaatattgaatcttctaacaagaggggatgcaaaagccgaaactcaattatcgataatcgggcaaaatctttttgaggcgacgaccactcagaaagggccgagaccgctggcaagattcctctctcagcgaataagtagtatctgcggcaaggctcctgaaataaagcttcttaacggaaggcacacggcggtctacaggagattaatctttcctgacttcgataaacttgccgaaaaaaataatgctgaaagggaagatactatcaatcatgccattgatgcaatgcttgttgcttttcagatgccagattacgcatggcataaaaagggttttcatgattataaagactatgaatattgggctaatagagtaaagaatttcgctcctgagaaagatagcgaaggattgcccgtattcagtcctgaacgtcatcccaagcccatattaggttttgagaaaccatccgtagtaagttcaaattattattccatagacatcctgagcacttcatggaatagaaggcatatggctacgcataaacaagagccatacggtatgtcaaataaaaaggatcctacaaaagaaggagtgccgataagaaaagagcctgcatcaaatatcgtcaaagaaattcttgatgcagaaaataaggagaagctgaaaaagtttatagatagaatttcgcatcctgttttaagggaaaatcttcttctcgcgttagaggaagaacattacaaagaaataactgcatgcatgctcgtaaagtggcttcaaagaactattagcaacacggttgaaaaaagccgtgaaaagaaaaaatcgtatttttcaaaccacccgagttcactgcttcgtaagaaatatcttgaagattttgtatgtgctgatatagatgacatattggtgtcgcctcaggcaaaaattccaccgaatatcagcataagaatggctgtagcttctaacatgaaagggcagattaatcttaaaagaagcgacaaaataagaccggatagattccatcattatatgtctcaacctaacattaagatgaaaatcgttgcttataaggcaaattctgctggagttatagacagatcaaatcctgctatccttgaagtgatgcagagttggcaggtgctgaataataagaaagaaaaaataattgaggacgaaaatcatgtcttgaatggaagaatcctttcaaacggtattaaggaaaaagatttccttatgaaatgggaagcagaactcaagaaatatttcgcatctaaatcctttaaggaatggcatcgcattactcagggaaactatcttgaatacgaaaatggagacggatttttcattagaaatttcaaaaaagaaaaagacggatataaagatggcaatctaaaaggcatcgttaaggtctggcggtcgccgtataaatggctggcaaatggtgatagcgcttaaataaattccttttagatggccatcataatttaacctttaaatatcctaacccctatttggctaactaagcgttgcattattcatgcaagaggcattagctggagtgccaggggcgttttacagttttccaagctctttgattttcgcaaacccctcagggtttatttcaaaaaatagcttttcggaaaatttttaaacttgcactgagaaacccattgaatctacagcaaaatgtgagcggcttcaatctcttttatcaaagaaccctaactgtaacataccatatattattgtgagcatcccactgcgccagcgcttcaatctcttttatcaaagaaccctaactgtaactacataataatgtatccattcttttgccctcctccagcttcaatctcttttatcaaagaaccctaactgtaaccacacaacgccttacttacccttttgccgagttctgcttcaatctcttttatcaaagaaccctaactgtaactgaatattacgatgcgaaacttgggggatattgggcttcaatctcttttatcaaagaaccctaactgtaactcttgcagactggcaagtcaatcgtaacatcgtcccgcttcaatctcttttatcaaagaaccttaactgtaactagtggaaaacatctctatagacggcggcaacaagcttcaatctcttttatcaaagaaccctaactgtaacatcatctggtcattttagtttctcaataaattctcgtgcgccttttagggcgctcctcactgtatcaactctatgaagcataccacggtaataccccgcaatatgaagctcctcatacaacgcatcaaataaccttgggagtttgccgttatggatagtagcatattttttaagggctttctcgtattcttccacctttttgggaagatcctttttaggcactcccctctttaataggtatgcattgatcgcctcaagcacaccgagataggctacgccgcatgcagattttacgtatttcttgtcgacgtatatgccttcctctattgctgttttgcttaacagttcttttgcattctgcaaatatctaagcgcctctttctgcatctatttcgctccctttgcgttctcaaagtatctggtagactctttcatggttctgttatatgattgcattataagccgaaaatttcaagagaaccgctaatctgcttttagtgcctgcttagttcttctttgcttgcggtgacgcctttaatctttttcggagattttttagccgcctttgccttgaggcctttgtaaatctcataagcagtcttgggagtggcgttgtcatggaccatcgcccggacagcc

SEQ ID NO: 125 - DNA, 14403 bp, synthetic construct
  misc_feature 1..14403: note = Synthetic
  source 1..14403: mol_type = other DNA
gtgctgttttagtcaccggagaatggacgctcggccgcaacgcggcggtaggggaaccaaaacagccgctggttttagtcaccggagaatggacgctcggccgcaacccggatcgtaagccacctccgcctccagcgttttagtcaccggagaatggacgctcggccgcaacgctggtatcgaccttgcgttttgttgggtagttttagtcaccggagaatggacgctcggccgcaacacattgttcgcacctgtgaacgtcgctgacgttttagtcaccggagaatggacgctcggccgcaacgcggcgtcgcgcgcggattgaatggcttgcgttttagtcaccggagaatggacgctcggccgcaacgcgcaacctggttggaagcactctgttgaggttttagtcaccggagaatggacgctcggccgcaacggggccggccgccggacgccctttcgtgctgttttagtcaccggagaatggacgctcggccgcaacgacgacttctagccgccctgctagaatctggttttagtcaccggagaatggacgctcggccgcaacgcccccggcggggcggaaacgtagcccgaggttttagtcaccggagaatggacgctcggccgcaactcaaaccaatcttgtcgtagacacgcgtttgttttagtcaccggagaatggacgctcggccgcaacactctatcgtgtcggcatacgtactgccaagttttagtcaccggagaatggacgctcggccgcaacgagacgcttggcagatcgtcacgcctttgcgttttagtcaccggagaatggacgctcggccgcaacggaggcttacgttaacaaccgacgtgtaggttttagtcaccggagaatggacgctcggccgcaacgtccagacgatgctttcaattgagcgcgtggttttagtcaccggagaatggacgctcggccgcaacaaaattgcaggaatgtcgctggctccgagagttttagtcaccggagaatggacgctcggccgcaacccaattgcagcaacccgtttgctggtaaagggttgccgcaataaaagcacaaaaaaaccgtggcttgccgggaaaaaattcccagaccaagtgcggttttttttcactgggtgcctttcgggcaatgcggccggcgcgatggttcaacttggcgaacctggcaatgacgacagcgatttttagagcacaacagcggcatgtgcgttacgttgactaccgactatggttcgcgcaacatcgggctggcgttgatgcaagctcatgccggtcagcgtccgacggccctctatgccgcaaccatcatcgtcgagcctaagcccctgaaggagctagtggttcgtcgtgcccaactgcggcggatgcgccgtacgcgcaaaacacgtcgccgtcgtctgcgccggctggccgatgcgttgcggggcatcgccggtgcggagacgatagtgcgtttctgccgtcggcggggttattcgcacgatcccaaacgggaacgggaggggcgcggatcggacgactcgaacagctcggagaaggtgttgttcgccgtttcgcgcgaggagttcttcaaggcgctggaagccgaggtacagcgcgttattgccgagccggaccgccagcgcgtactggccgcctgccgccgacacctcaacgctgcgcggctgcctggcgccgagttgcgcccaccgcgcttcgacaaccgcgccgtgggccggtgcggctggcaaggctgctcgcgtcggccgccgcgggccgaaaatgccgtctgggagtgtctgcgccagacgctctacggatggttgaagccggtcttcgacgaggcgctagcgaatctcgagcaggccgaggctgccaaggccagggccgcgatgtgcgccgaggtcgatcaatggtgcagcgcgttggtaaagctggccgccgagtaccgcaagctggccgaccaacagcccgcccagcgcgacaaaaaggacgtcgataagacaatcgccctgctgacacgcagaaagaaacagctgtatcggcagatcgtccgctgggtgcaggacacggcgccggccaaagctggcagaaagttcgccgcggattttgaagcctacgtcggcaaaaaaggcggcaagggcaagcagaaatcgggcagtgtctcggccgctggcgcaaggcaagccggcgtccggcagaaaaagaccaaacgcggcttccgcaatcagctggatgatatcgtggtcaaaggccggtccggccggctgcggtattgccgcgagcactcggcccagtacatccagtatttgcttgatggcaaacagattcccaaccgggaagacgttctggaccgcgacatccgcagtcggcggcagaagatcgtcttcgaccggctgtggacgctgatccgcggccggctgctgccgctggccggcggacgcatcgaccggattgtggtcgagcgtgtggccttcgacgtgctggccggccgcttcaagcatcgccaaaagttctatagcggcaaagaggaaagagcggccgagatgtattggttcgggccgggttacggcttcgacagcgagttggagatgctccgcgaagagtttggggggcgctgcgcgtactgcggccagcaatcgcaagacatggaggtagagcacatcctgccccggagtcggtttcccttcgattcatatctgctcaaggtgccggcctgccgccagtgcaacatgagaaaaggcgctcgttcgatcacggaagccaaaatgcgcatacacccggatgcgtatggggcatacgagcgatacctggaaaaacgcaacgtgcgacattacttttgtgacatcaaaaaaggtgcgctgaagctgctgaccaacggaacacagaattgggacgcggagcggctgttgggaatgatcgcccagaacattcttgaaatgggcaagtcgcagaacgcgtcgcgtgcattggcgcgctggctggccggaaagctggagcgcgaaaccggcgtgcggccagaggtggtcttccgcaacggcagatatacagcagcttgccgcgaagtggtcctgccggaatacgacaagcctgctgaaaagcgcaaaggcaacacgcgcaaccatgccgtggacgcgatattactgggctgtgattttcccgcggtcacattcgtcgatgcccagggaaagtggtggctttcggaagaccgattgcgccactgggaagaacaagtcaaggccgccgcgccggaattggtagaactgccaggccagggcgatgcgccaccggcaaaactgccgcgggtcgaagcgccggcgccgattcggttcttcgaggaggacgttgggggtgggtatttcaaaatcgatctgtcggcctttgggtggaatcggcgccggcaaagcgggacgaaggttgacccagtgcggaaaatcacaaccgcaaacggcacgcgccttgccaagcgcgagccggcgcaagcggtactggacaagctgctggcaaaggaaaaagatcgcgataagtgcattgcgttaatcgccaatcggcgtctgcgccagttgctccagagcgatccggacagcgccgccaggaattacgtcctgtggcttcagcgccagacagccagaggactgcgcgcggcgaagatgggcaatcacccggcggacataaagcggcgccaaatgctccagcagttcatcaacacgccagttgatgctttcctgcggccaggcaaggagcggtcggcgcaggacgccccacaacaggcgcaatccgattatgcacaaattcccgaggtcatcggtgtgtgttgcttgatcgaccagggggaaatcaagtacgacgtgccgcgttgcgaccgcgtcgggaagccgattcattactacgccagccagccggcaatacgcgcattgtacgttggatacaaacgccgcaaagacggaaaactggaccgctccaagccggtgattttccgcgtcaatcaggtctggaaggtgtactacggcccgcccggcaaggaccaagacagccccgcggcacgcgaggtgatagagaaacttggacaggacagtccgctgcacggacgcatgctcggacagcgcggctcctggcagaagttccgcaggcgatggcacgaggccttcgacagactgtgggccgacttgggcgtggagaagcgtttccggattgcccagggcgcggtgatcgaaaagaccgacggcacatgtttcctggttcgcaacttcgatacctccgagccttggatgaaaggttccccctggaagaacattcgccgcgtatatcgctcgccgttgcactatctggccgccaaggccaaagcggcatcgcacaacgccgctcagaccggcgcgcccgttgccgaaacactcagctaatgcgacggcgccaagttgcccattcgtaacagcccgttgttgtgcaagctgcccttgcaacacaagatattgcgttctattgcaagttagcgctgtggtttttcgcggcgcggtcgagcgcccttttcagggctttggtttgaagtaattggccttttttcccggggctggcggctctggctatcgacgttgcgccgctccgcagcgggatgagacctccaagcttgtgtgcttcgattttgcaggcaggagttgtgccagcaatcagatgggtagattgggaggagacggcttgtcgacggccttgcggccgcggctcggttttggcacccttggcaaacgatgagatgggcaagcgtttccggcggaccggaacatgggtaagcttcttccccgaagccgaaccaaccagattttccacctgcaatcgagatgcacacacgtcccctcatggcaatccgattggtctttgtgcgcaatcagtgcggagttatacttttcgccagcgcatagggggcatgtcgtttccgatcgtcgaacgtacggctggtaatagacctcagcggcgatcaagtagcggtcttagcgggcgaagcacaaagttgccggccgcgcaggatgttgggggctggcgaaatgtgatgtcgcgcccacagcgattgggaccccgctggtcaatgacaaccgtggcctttccaggcacaccgcaacagattatatcgattgactttgtgtctttgtgtctaggtgttgcggcaaccgctggggcgcctgttaaggagggaaaatcggcatgggcatggaagccgctgcgttgccggtggtaagtgccggtacggtggagcagcttcgcacggcacggcaagttctgctgcgcgaaagccaagcgctggcccagcttgccaatcggctgggcgaggagttttgccgcgcggtggacttgttgtgcaaatgtcagggaaaggtggtagtctcgggcatggggaaggcgggcctgatcggccgcaaaattgccgccacgctggcctcgactggcactgcttcccattttctccatcctgccgaggcgctacacggtgacctgggctgcatccggcagggtgatgtcgcgctgctgctatcgcagagcggccaaacgcaagagattctacgcctgctgccctgcctggccgagctgggcacgccgatcatagccataaccggttgcgccacaagcagtttgggtcgagcagccacggttacgctggaaatcggccccatccaggaagccgatccgctcggcctggcccctacgaccagcacaaccgccatgcttgcactgggcgatgcgctggcgatcgtcgctgcgcagttgcgcaactttggccgagaggatttcgcccggtttcaccccggtggaactttgggacgaagactggccaaagtggaagaggccatgcgcccgctggagcagtgtcggctggcgcacgaggggctttcggtgcgggaagtgcttgtcagcacccgcctgcccggccgccgcactggggccaccatgctggtggacgattccggccggctgagcggcatttttaccgacagcgatctggcccggctgttcgaacagcgtagggaaagcctgctggacagtccgatccgggcggtgatgacccgcgagccactgcatgtgcagcaaggaacgacgatgagcgaggccatcgacttgatggccagacgcaagatcagcgaactaccggttgtggacgccgaaggccgaccgctgggactaatcgatataaccgatgtcgtcggtttgttgccaaaagattgcccagagcaccagctctggccaaccgatagcgcatgcaccccaaacagcgggaaagagggtacgtcgggaataatgcctgcggtttatcgcatctacagtgaaccggccgatggtcggccagcgtaatcaatgttgccagatgttctatggagccatcgcggtttcgagttgtggcggtgcagcagcgcgctggcgtgctatcgaagaaccgccgcttgccacgggttcgaccgggcgaccgctggccgccaggcgctcagctgaatgtctcggccggtcagtcaagcgttttggaagattggtgtagcccggtcgatagaccggtcgttaatgtttgaaccacacgggcagtagctctggccaatccggttggcgcgggccgcagtggaaggcgttcggaggagaaacgtctcgcttcggcccgcgcaaagcacaattcctgccagcgttgatgacttccagcaggccgaaactgctgtttgcttcccgcacggtcaaggcggccgtcagtttcgcggtggtgctatcgctttactggctgtatgcgttgctggccgtgccgctgatcgagccatcggcagagccacatcgggcgttggcgcagtcgggcagccagagcgccggcgaagacccgcggctagaggagttgcgtccgctgtttccccccgatgcctgggaactgcaatcgcccaagattatcgaaagcgaccagctcaagctgctgatgcaggaaccgcgcagcctgggcgaacgcagggttcaattgcgtccctgcacgatgatattcctgcccagcaaagcgggactgagttaccaggagcgcatcagacaggcagtggtgctgcaatcgcccgagggcgcaatactggagttcgatcagccgctgaatttgcgccggatggaaatggggcgactggtaggcggagaacttaccggcctggtgaccatccgcagccaagggcaatcgccggggccggaagacgatctgctgatcgttgcccgcaatgtgcagatcaacgagaaggaaatctcgactgtaggtcgggtggagttccgctgggggcctcacttcggaagcggccaacacctggtaatgaagctcgccccggccggcggcgatgcaccacgacggggagcaaacatcggcggcctggaatcgttcgagatccgccacgtagaacgattgcacctggaagtagtcgacttgcccggccaaaagccgccgacaagccctcgcccgcaaccgcgcacggccacgccgatcgaaattacctgccgtgggccgctgcgtttcgatccggtccgcaaggaagcgactgttgaagaccgggtgacggtatggagcatgggccagcacggggcggacaatcaattgacgtgcgacttgttagtactggcgctgggcgatcagaccgacgcccgtccgcaacagcagcagcatcggcagccacagcagcatcagcctcagaatcggcatgaggctgagcatcaggagcatcagcaacggcaccagcagccgcaacagcactcggccagcagcgcccctggcggtgcggaagccggacaatcgaatcaccggggcgatcggttttcgttgagcctgcggcggatcgtggcgcagggcactccagccgtagcgatggttcccagccgccagcttgccattcgcgcccgacggcttcaatacgatctgctgctccagcgcgtcactctcgagggcgagccggaagtgatgcttcgacaaggccccaacgaagtgcgagcccggagcataatctacgaatctgcggacgccggcaacctggggcgacttttcgccgatggccccggttggctcagagcacacttgcccgatcggcccgaccagcagctttacgcccaatggaacgaacaccttcgctttcggccgcacgaacataatcaattgctgtcgctgaccggcggcgcaaggttgcgctttcgcggggtgggcgaagtgacggccagagagattcacttctggttcaaggaaaatcctgctccgagtgcgccggctgctgtgccgagtgcgccggctgctgtgccggctgtgccacaggcgtggcccaagacggcgcacaatgtttcggcgcgcgccgcatcggcgcgtccggaagaatcgtccccccagcccagccgcttgcgtcccgaccggatgctcgcccaacacgatgtggtgatcgactcgcagcacgtaaccgcgcggctggagcagttgggggtgtggttcgagccgagagctccggcaggccggccttcggcgggggcaacgggtggattgggcagtggcgccgcagttgtcagtacgtcttcgcccaacgaatcccgattgatagcccctgttgctgaggccgtcgcgggccacaacgcgccttatgcgctttgggcggtcaataacgtcgcaggccgcaatgcgccctctgctcacccggcgcccgatgatgtcgcggccagtatccctggcgaccaagccagggcaaacagtacgtcggcaacggggttgcgcgggctgctggcagaaccccgtaggcgattcgaagcccaaggcagatcgctgcgggccagagttctgttggacgaggacatcggcacttccgccggcagccagttggcaccgacggcagaagtgcccagtcctcatcaccacagcagcgacgccgaaatagccgagttgatcctcgaagacgacgcgagattcgcggagtcgcttgccgcaggaacttcggccgcaccggtggtcgtcagcggccagcgcatccacgtggtcgaggctagcagaccgcacgccgccataaccgtagtcggacgcccggcgctgttcgagggacgaggtctgaaactcagcggcgggaacatcaatctgaatcggggcactaaccggctgtgggtcgatgggccgggagaattgcaactgccgttgaagcgaaatctggacttcccgctcaagcaacatctggaaaaccagccgccggcgcaacccggcacgctgtgcatcgattggcggcagcggatgcacttcgacgggcgatcggcgctgttcgaacagtcggtcacggcgcgcggcccggacatgatactttccaccgaagtgctggaagtgcagttgcagcaggcaatagtcttcgccgagtccggccaggactcccagccacagatcgaacaaatcctttgccgggggggcgtgacgatcgaaagtcgccgcctgcgggaattggaattggtatcgctgatgcgcgccaagctggccgacctggcatggcacattcccagcggggcgattaccggcggcgggccgggctccatggtgggagtgttccgcggcactggcccagcgaaaactgcaaacctcgtgccgcccttcgctcagccgcggtcgccacaagctgcggccgcgcaagaccgctcgggcgccccgctggattgcctgcacgtgcgattccagggttcggttcgaggaaacaccaacaccggcacattggggttctacgaccgtgtgcaagcggctttcgcaccagtaggctcctgggatgcaacgctggaagtggatgatccgcgagcactggggcaatatggtggcgtgctgatcaactccagttgtctgaccgtgaccgaaatgcccagtcccccagggaaccagcgaaccctcgagctggaggcgaccggaaacaccatcgtggaagcggtcagcgaagaccagcggctctacaccgcccgcgcccagcgaatcgcttatgcccaggcaaaagacctgcttgtcctggaaggcgacggacgcaccgacgccgagctgttttatcaaccccaacccgcagcgcaaccctcgcgtcaagccgcgcgcaggatcatcttgtttccccgttcgggcaaaggttgggtcgagggtgcccgcagcctggagctgaccggctttccccagtgattcggcgtgaagatgccagccgctccacggctggccagttgttgcgacccgtcgccggcgcagcattgcttcgcagcaggacaataatgcggcccgcggccgcaaccaaactatgttactggagggacgcgctgcggtcgcgtccgcaagccctcggggcacggccacgacggagcgtgtccctccagatcactcgaaaacatggacgcaaaaggggcacaggtggtctcgtaaaggtctaacacccaatgacgcctaacgagcccctgcctcaagccggttgccacaccaggaacaacaactgcattggcggttggaaatcaaggcagttgccatgtaatggacgacaaccgcgatgaggttggaaatgcggggtttcttctctctaccggtgtatcaagtacaattattgccactggggcgggataagcggaaaaccggccagcgcccgcgcagcctgaacgggtcggttagcagtacaccattctggtagcagtgcagcttcttggaagccacaacggctcagttcggcctgcgcgaggcatatcgtacgaaagtcccgcgtgcgggcctggtcgatgccagctacagttgagcagttgaagtatccgccaaaatatcggtgagccatcaaaatgaagactctactgagccaagaacaactcagcgaaggcattcgccgcctggcagagcaaatccagcagcgatatcaaggcaagccgctgacattgatcggcgtgttttccggtagcgtgatgctgttggcagacctgatccggctgctggatatgccattgcggatcaatgtcctggaagagcggcgcagtctccggggcgatcgcccggggcctccggccatcaatatcgatcaactgcgctgcgatgttgaaggtcgtcacgtgctgctggtcgatgacatcttcgtcaccgggcagacgctctgggaactggtgccgcaattggacgaattgaatccggccagcgttcacagcgtggtgctgctgcgtaaagcgggattgcaaacctcgccgatcagcccggacttcgtcggcttcgatataccagccgacgtttacgtggtgggctacgggctggattaccaggaccgctaccgcaatctgccttacctggccgcgctggaacctcaagaccaataggctcgatagcagtgaagccactaaggctggtgttggtggtgcgccacttctggccgattctagacggcccggcgcgactgacggccgaacttgccgcaggacttgcacgccggggatttcctgtaaccattctgaccgcccgttggtatgaatcctggccggcagaaatcttctttcgtggcgtgccggtgatgcgcattgggccggcgccgcgcggcggctggcagacggtgcgctacttgcacgctttagcctcgtggctgcggcggcgccgcgggcagttcgacctggtttgtgtttccggcgccaccctcgaggcgttcgccgctgcgctgggcctgcgcggcagccgccctcttgttataagagtagaacgagccggccgcgcaggcgattgctactggcaggaacattccagttgcgggccgcacgtcaaacgacgctgcgcagaggcaacagtgctcgtcgcgccgtggcctggcgtggtcagtgaacttctggcacgaggttactgcggggaacgaatacggatgatacccaacggcgtggctattccgccggaaagcgacaattcgcaaaagaccgccgcccgggccgtcttgacacagctttaccccccggcacagatgccgccctgggcgccgctggccgtgtacgtcggccgcctggactgccgccgcgggttgtccacgttgctgcaagcctggcggctgcttgccggccgctggcccgatgcccgactgtggctcgtcggcgcaggtcccgatcaccatcacatccaacaaactgtgcacaccctggcattggacggacgggtacacctgctgggagcgttcgactgtgtggaccagccgctggccgccgccgacgttttcgtgtggcctgaccccgagttcggaaccggcgcggccattatggaggcaatggcggcaggcttgcccgtggttgccgtggatgccgagccggtgcgaacgtttattggccaggatatcgctggtgttcttgcggctggccagaacgctcaagcattcgccttggccatcgaccggctgttcggcgccccgcagcttgccagtcggttgggggcagccggccgacggcgcgtcgagcagcagtactctgccgcgaaaatggtcgaagagcattcgaagctgttcgagactctggttccacagtgaccgtacgcatccttcacatcatcgacagactcgactgctacggccccagcaggcaattgtcgctgctgatgcatgggttgccgcccagtcagttctgcaatcgcatcggtgcgctgaaagttgcggccgatctgcccgaggaactggccgccgtaccagggaaaatctgtgtgcttgccagccgggggttgctcgatccgacatggccggtccgtctgcggaggttgctgttgcactttcgaccccagataatccacggctggggccgccgcgccaaccttgtggcggcactggccgccgttgtgcagcagaaggcagctctgatcgtcagccagcggtgctcgctggagcaatgcggctgcatcgccctgttgcaggcggcgatgttccgaagggcgaagaagatcgtcgtcaacagcgctgccgtctgggatcaatgcgtcgcctgtggcattgcgaaggaaaaaacgacgctcatctccaacggggttgttccccttcagacgccgccggtctcgcgtcgccaattgctggccgagcttggcctgccgcccaacgcacggctggtgtgcgcgggcggtcgcctttattcccacatggggatcaaagacgccatctgggcggccgacctgttgaaagtggtccgaaaagacgtgcacttgctgatcgtcggcgatgggccgcagcgcgaccggctggtggcgttccgcgatcaggtccgcatacaagacaaggtacattttctcggctgccgcaacgacctgcgctggatcgtcgcccattgcgacgttttctgggctgccggccaccgcagcgggcagcccaatgccatactggaagccatggcggcatcggttcccgtcgtggcgaccgatgtgcctgctaacaaacagctgcttcagcacgatgttacaggctacctgatcgcccctggcgaccgtgccgcgctggcacggctcaccaatcgattgctggatcagccggaagtggcagaacggttggggcgagcggcccgggaccgcgccttggccgagtttagcgcagccaagatggtcgctcggtacgcccagttgtaccaggaagtgctttagtcgcctccggcactgcacaaatacgccggccaacggctacgagtgcatggcgcttcggcccgcctgacaaccagctccacgagtcgtaattatgctatctgacactgcgcagccatgagcctgcgctctggtcggtgttacgcccagcagcgggcggtaaacagttcgatttccagtcgcagcagattatcgaccagttcggctggcgtttgcggacggcggagtgggtctttggcgatcatcgaatgcaccagccgagctacatccgccggcacccaaggcgccagcttccgaagcggcggaacagccccgcaccggtgcgccgctaccagctcgccgatcgtctgcccctgatacggtagtcgcccacttaacagctcgaacaatatcacccccaggctgtaaatgtcgctgcggatgtcggccgccagcgctgatgtgaaccactctggggcaaggtaattgcaggtgccaacaagccaccggtcggcgatcgagccgctttgctcgatcggtcgggcgaaacccaggtccagcaatgttacatggccgttgggactcaccatgatattgctgggcttgacgtcgccgtgcagccagccggactggtacaatgccccaagcgcttcggcagtctggcgagcgatccacaatgcctcgggcagatcgaactgctggccccattccaaccgctgccgcagtgtggccccgtccagccacggcatggccacccacaagggctgccgacgaagctcggcgccgaccaccgacaccaggtgcctgtgagccacacggcggcccacctgcgcttcgcgatgcaacaaggc

SEQ ID NO: 126 - DNA, 5955 bp, synthetic construct
  misc_feature 1..5955: note = Synthetic
  source 1..5955: mol_type = other DNA
gtagcaactgtcttatctgtcaagaggccaggtgttcttgccaaggttgctggttgcggaccatagcgttgagaatggtcaagagttttcgcatgcaagccacgatagcgagttttttgggtttaccgtgttggagtaatcggagatagaaagcctggagggtttggttgaaccggatgccgacgagggcggccatatatagtttttctcggaccgcggcccttccgccccaggtgcgtctttttcccttaagctgtccggagtcgcaagccagaggggccacgccgaccagggcggcgatttctttgcggttcaggtcgcccagttcgggcagggcggcgatgagggtccgggccacgaccgggccgacgccggggacggtggtcaggagtttttctttggccgcccaggccgggctttggcggatgcgctgattcatctcctggtcgagtcttttgagttctgcttccaggtaacggatatgggcgtcgatcatggggtgtagagcgggcagggtggaagcgcggcggtttttctcggcgacgatcatgtccacgatctggcggcggcgagagacgagttccttgaggaggagggcctcctggtccgggatgggccttaaggcgggccggacgctttgggcgaagcgggccagaacgaggctgtccagacggtcggtcttggccaggtggccgagggctcgggcgaaatcacggatttggcggggattgacggccgccaccgggagtccttccgcggccaaggcggtcagggcgggcagttccaggccaccggtggcttccaagacgatgagggcgggagaaagggcggagaggcgccccgccaaagccgacagttcctcagggcggttgggcgtgcgccaggtctgaccgctggggaggacggccaggtcaagatggtctttcgagacatcaataccgatgaaaacttcagactccgagggcttcattttccttctcctttccggtatattggcaaagagggcttggtcttctccttttgtcccggccttgcacatgcgggcttgccggcccagacaactgtacgggataaggagagaaatgcgcccggcgacctcgctactgagcggtcttggatgacccaggggcgagcggcctgccgggcgcaggccggtggctgtcttcgttcgctaagctcactcagccagccaccggccacccctttttgctcccctcgattcataaactatctctagaccaagatacaaggggcggacctgcgtgtccgccctgattcctccttccccccgttgattgtaggggcaggcccccgtgcctgcccttcgacaatacccggcccctgtgtccgctctgatcccccttccccccgttgacggggggataaaaggggggcagactttttcccttgcccctcttcctcaaaccgcctatcatcatctttagggaaggaccatcgtctctgctccgctgaggggaagcggaccactcgcttgactttcccgataaaatgagctactataccttgactttgggaggcgcggcgtaattcctgataaatcatttccaaaccccactggcgttcccggtagttggtatggaaaatttcaccctcgccattgatttcggttccgtcaatatcggcttggccctggtttgtaatagggacggcgtcaacgaaccactctttgctggcatcattacttacagcaacgaagtcttgaaaaagaaatccaatccacgcgcccagattaggcgcctgcgccgaacccgcaaaaccaaaaaatccagattaaaccgtctgagacaagccctgttttctctcggccttgaccaggacgtagtcaacgccctagtccatttctgccggcggcgcggctataaagccctatatggtgcagaccgggaagctgaagaaaatggacaggccgaggaaaccgtcttccgttattcccgcgaggaattcttccgcgccctgaataaggaaatcgaccgccttctcccgcaggacctgcgtcccccggttttaaaggtgtgtgatcgcgtccttaaccgtcacggcgagttgaaccgcgaaatcagacccatccgcatcgacaaccgaggcgcgtcccgatgcgcgtggtccgagtgcgacaaagtcccgcccaggcgcaaaaacgccatccgcgacgctctggcccagttcgtttacgccattatcgacttgccaaggttgagaaacgacgaaaacctccaccgcgacctggacgcggccctggacacggtggcggagctggccaaaagactgcgaagtgtaaacggccacgacccggaccgggagaaaaaggtcttacgcaagcggattcgcgaagccttgaagccggtcaaggacctggccgccttggacacctggaaggtcaattccgagaacatcatgaacctcctggaaaagagccagggacgcaaccgctattgccgtgaacacagcggcgaatacgtccgctgtcttctcgaaggccggactgtgcccttcaaggcctccttggtcgaacgcgacatggtatctagacgggaagaaatcctttatcagaaactttggcggtacattgaaacaaggattctgcccctggcccccggcggcatcgaccgccttgtagtcgagcgagtggctttcgacctgctggccggcacacgcaagcagcgccagaaggtcggtgacaagacggtcgaggaaagctaccaattcggcccccgccatggcttcaaaagcgatctggaaatgttgcgccaggaattcgacggcctttgcgcttactgcggcaagccgtccggtcaaattatccagcgggaacacatcttgccccggggggactttctctttgacagttacctcaatatcctcccttcctgtcctgcttgtaatcaagtcatcaaggccaaggcttcgccccaagccgcgggtctgcatgttcatgaaagcgcctatcaggcctattgccgctacttggccggcaagttcaagatccggccgccccatgaataccataccatcaaaaagggcctgctcaacctgatgcggcagcccgatcgcacttgggaagcggaacagtacctggccctcatagccggtcacttcactcaggtcgcccaaacccagagggcaccacggcccatggcccggttcctatgcgaacgcttgagacaaagattcggccgctcaccccagttagccttccgaaacggtcggcacaccgacctctggcggcgggccgcctatcccgattttgacaagctcaaggaaaaggaagagggcggtctgatcaatcacgccctggacgccttggtcctggcttgcgatttgcccggaatgaccgccctggaaggactcaacctcaagcctaaggagctcaagtcctgggtccgggctgtgactgtggccgccccacctcccggaccggacggcgtgcctgtagcgcccgaacctggccgagccgtacccggtttcgaggaaatcctgcccggcaactatctgcgggccgatctgactttttttaactggaaccgtaaagatttaggcgtccagagtcaggacatctacggctggagcaaaaacgaaaatgtcccgaccaagcgtaagaccgccctggaccttgtggccgaactgcgcaagcagacgaatacctctggagtgaaaaaaatcatcgacactgtggctcatcccaatcttagacaagccctgcaggcggccaacaccggggacaagcccggagaacaggccgttcaggccttgatcgattggctccgccgggccataaaaccggccttggacaaggcccgattttccgatcatcccggggatcaagccagacggaaggccttgcatgactttgtttccggcaacctggacggcccccccgtaaccatcggcgtcaaaaggctctacccctatggttctggcaagaccgacctgcaaagaatcgatccgaaaaccggtcgtctggttcatcgttacatagccgacccggccaacaaagcccttatcgccgcctatcccttgaaaaagggccggatcaggagggatagccccattattctggaagtcaggcagaacgacgccctaaaaccccaaggaaaaaccttggcccgacctgcttccgggccgttggccggacgcggcctgggccgccccgcccctgatcccgaccaatggaaggccgaacttcatcgctgcctggccgaagcgggcgtggccgaatacgccgtggtagcccaggggtgcgtggtcaagtacgaagacggcagtgaaaaatacatccgtaatttttccacaagccagggattcaaaaatgggttcctgaagaatattgtggcggtccggcggtcgccttttgccgcggccgagacggccaacgtcaggctgttctgacagccgccggacctgatagttctttgaaaaatggaatagcttgttcaggctgaagctgaaaagagcatccgtccggaaggtccactccgggttagggcagatccggctcttggtcctctcctggcccttttcgggctccgagaggaagccttccggcatgtcttcggacaggatgtgagccttttttactttaccctgaacttttaaatcccattgggattcaggtcgcggctttcattcacggcctgagcgtgtttcagttaccctgaacttttaaatcccattgggatgttttgcgaagttgcaggcgtcggcagtacttcgagtttcagttaccctgaacttttaaatcccattgggattcgtcgttggcccgccgatcgctctgctccaaatgtttcagttaccctgaacttttaaatcccattgggatcccagtccattttctaacctcgcaatcggccgctgtttcagttaccctgaacttttaaatcccattgggatagatcgatagcagctgccaggcgaaccgatagggtttcagttaccctgaacttttaaatcccattgggatcccgctccgacattccatgcaaaacagcatggtgtttcagttaccctgaacttttaaatcccattgggatgttcatggcctttaaaccggcgttgtaagcgatggtttcagttaccctgaacttttaaatcccattgggatgctattccatctttttcgaatccgcgcaggctgttacagattcgctagcgcgaagcgccctttttttcacccagtgggaaaccttttcgaatgctctgctgggtcaaccaaatgatataaaaggttacttactttgcgcgaaacaatctttcagtaaacggcggcggggatgttccagccctcgccttatcccttttgctggcgggggccaactattatattgctgcgcgaacctcgtcgaccttagcttgccgcttgatgttcgcgcggattataattgtttgcaatttcgtgggccgcttcgccccccctcaccaatcccgagtgccttttcaagcccggcgaagatgaacttatgacccccatcaccaccgccctcagccgggagttgaaccgcatccgccgcaacggcctgaccgggccgaatctggtccgcaacctctcccaactctaccatcagcacaacatgcgcgattgggtcgaccgccgggggctcaacctggaagaattggccattccccaggtcgtttgcagcgaaaaactgggctgacccccttatctgatacttcgaccatctacgctgattgtggtccctccgggctggccataccccccgccacggttcgtgtttttgtaggggcgaccggccggtcgcccttacgtcgtggtcggattctgtaacggtgggattgaacccccgaccttgaccaacggcgtgttttcccggtcaaacccgccacggttcgtcgtctggtaggggcgaccggccggtcgcccctacgacgggcgcggccctatcggggttttcccgttcgaattcccatccgggccag

SEQ ID NO: 127 - DNA, 6992 bp, synthetic construct
  misc_feature 1..6992: note = Synthetic
  source 1..6992: mol_type = other DNA
ttagtggatagtggttagtggatagtggttagtggatagtggtcctgtattggttcagcgtggcgggttcgggacatcatacaggggaaactgggggtggcgggctgagaacctccgcatgccgcgggcgggcagactgcgcggggtcggaaaaagggcctcggctacctcttgtcactgcgtcgcccaaacgatttcccgaacaagccaatcagcataaccaacgtctccgcgggaaatcaccggggctacccgcgatttgggaaagtccttatgcgtcgccatgttcgaggtcccgtatcatggttttcaccgttccgattaatgccgggatgcgctccatgcaaatcgtgtataactgctcggtatccacatcgaaataaccgtgagccagaacgtccctaagtcctattgccccgcgccattgcacttgcgggtagcgggcaaaaagcgtgccttctgtttggcgatcaatgttcttgaactcctcgccggcggcgatcaggatcatacagatggcatccatacggtccagtccggcctcgctggccaagaaatcgcttgcttgagagatatcggcgcagcggcggggaatccgctgcagcgccgtcaatacacattgcagtctttccagcaataaatcggaatcatacataggtcgcctcccgttcgattctcgcttttaggcgtggattcatcgactctcgcagccggacaatatccaccgggtgatccagcagaccttccagatcctgtctcagcatggccgtaatgaacagatcggggcgatcagtccggaaaaccacatcgacgtcgctctcgggcgtggcctcgtttcgggcgtaggagccaaaatagcccagcgcgagcaaatggtactcttcaccgtgttgctccttgaatgatttcaagagcccacgtaattccgccggctgcaataccgccttgctcatatcgtaacctccacaatcgtcagcatgtcgttgtcgaagacagaatcccccattttgccaatatcggacctgtcccgtttcttctataccacaacacccacccagcgtgcaatgtcagcaggacacaaggcgtttttgggcccttcacgaataggctgcccgccgaaggttcagttccagcagcttggcgaggatctgttcgtcgggcatttcggggtcccagccgtaggcggcgaagacggattggtcgagtttctggtgggccagatctagccaggtgggacgctggttgtagaggttcgtcagcgtccgcttcttcagttgcttggcacactcctcgtccttgggcaccagccgaggataacggaccgtgccgatgccccgctcgtccggatcacggacgtaccgcccccacggcccgtccgccgagccgggaaactccaatacttcgcccccaaaattccttgcgaaaaccagaatggtgtcccgcgaaacccttgtgaccgcgtcgccgagacgatttcccgaacaagccaaacagcatggccaacgtttccgcgggaaatcatcgggggtacccgcgtcagggggggttgtgctgcaatggcaatgtggtaaactcaacggctggagcgttctttggcaattcgaccatgtttccaacaggttgcggctaaaaagagccacgaccgcacctcggcaccctgggatcggacggacagtccccggccctgctgctcggatgcttcatgcgcccgacaaacgacgcggtctatgtggtgagtccgtattttttgtttcgtgtaggtcaccctactttggacgcacaactccagcaaacggcagcacgaaggtacggctccgtacgttttagtcaccctactttggacgcacaactccagctatcgggatctgggccgccgggcggtgtgcgttttagtcaccctacattggacgcacaactccagcccgggggcggttcataaccaccaccaacgcgttttagtcaccctactttggacgcacaactccagcttcttctttcgtgagcactatcggccatttgttttagtcaccctactttggacgcacaactccagcccaccgcccgaatgatcgtcggcggcaacagttttagtcaccctactttggacgcacaactccagcacctgcaccacccgctgttggtgttcgttcgttttagtcaccctactttggacgcacaactccagcggccccaggtctcgtagcccaacgcctcccgttttagtcaccctactttggacgcacaactccagcgttttggtttcgccggtagccacgtttagcgttttagtcaccctactttggacgcacaactccagcacgtcggtggccgctgatgtgctcgcctgggttttagtcaccctactttggacgcacaactccagcccatgcctgggtgaatatgttcgagcggatgttttagtcaccctactttggacgcacaactccagctttttgagctgtaccacgtttcaccgcgatgttttagtcaccctactttggacgcacaactccagcacgtcttccgcaagtcgttggggggcgggagtttgcgacgcaacatggtcgaaaaaacggacgcatccggggccatattgtagaacggaaccgcggaattccatcggcttttcgctcctttggaggtcgtctgtccgtggcaactacctttacggtctcgatcgacttcggttccaagtatatcggcattgcgctcataatgcactcgcccgcagcacctaaccgcgtgctctacgcggccgtaatcgtggtcgaggcgaagccgctgaacgcgtcgatcaacccgcggactgtagcccggcgaatccgacgcacgggaaagacccaccgccgccgtttgcgccgactcggcctcgcactcggcggtatccggggcgccgaagacgtgctgcgattctgccggcgccgcggttacgcgtacgaccccggcgaagagggcgacgagaccgaactggcgcacgccgtctcgcgcgacgaattcttcgaggcacttgccgccgaggtcgaccgggtggttcccgaacgtgaccgcggatacgttctgcggcggtgcgggaaacacctcaatgccgagcgacgcggcgaggccgaattgcgcccggcaagattcgagaaccgccatccgagcaagtgccagtgggaaggctgcacccgcaacgtgccgcgcaagggcaacgcgttgcgcgaacagcttgcccaaaccctctttgtgtggttgcggccaatcttcgatgagatcggcaacaaggggcccctccgcgacgccgtcgagcgccagatcgaccgcatggtcggactggcacgcggttacgccaaccgccccgacgccgacgagaagaaggccctgagcaagcagaagaaacgggccttcgccgatatgctcgattgcgtggccgaccacggcgacgagcggacggtcaagcggttcgtcgacaactggagaaagacctattcgaggcagttgacggctatcctgaccaagaagcagggtgggcggctgcgctactgccgccggcactcgcgcgagtacgtcgacgtgtttctggccggcaagcagcctccacaccggaccgaggtccacataaccgatctgttcggccggtcgcaacagatcctcttcgagcgtatctggcggctggtccacgcgagaatcctccccttggccaacgggcaaatcgaccgcgtcgtggtcgagcgagtggcgttcgacgtgttggccgggccgttcaagcagcgcgtcaagctatcagaggaccgcgcggccgagatgtactggcacgggccgatgctcgggtttgacagccggccggagatgctcaaagaggagttcgacggccgatgcgcgtactgcggccggaagcgcaagctctccgaggtcgaacacatcctgccgcggagccgctttcccttcgactcgtacttcaacattctcccctcttgcgcggagtgcaatcgcggcaagggtgcccggtcgctgctagaggccgggaagaccgtcgacgaaaaggccttcgaggcgtattccgactacatcggcaagaagaggccgccgcaccttttccacacgatcaagaagggaatgctgaagctgatgaccgacggcgggtcgatggcgacggccgagcggcagcttgccctgctggccgacaatctggtctcgatcacgaacacgcagaagtcgccgcgtcctttggcccggttcctcgcaaccgagattgagaaactgacaggacacgactgcaagccgcaatggctctcaggccgccacacggccctctatcgcgagattatcctgccggagtacgacaagaaagaagagaaagagaacggcgggctggtcaaccacgcggtcgatgcgatcgtggccggctgcaagctcccctcggctgccgcgctggagaatccccgctggtacaccaatcagaacgacggtccaaagcagagcgatatgcttgcctggcggaagaaggtcctttcggttgcgccggaacttgccggccgtctacctcgggtcgagcccatcgaacggctcgaattcttcgagaacgacttgggcgacgggtacgtgaagattgacctcagcgcattcaattggaatcaacaacggaagtcgggacacaagctcgacccgttcgggacgacggctgacgggaagccgctgaagcgcaaagcggccgacgacgtgttgaagactctgctgatcgagtcgaaacgcgacgggcagatcgccgctattgcccaccggggcttgcggcagttgctcgaaagacatcgcaagcaggccgcccgccagttcgtctgctggctgcaaaagacgacgcgcaagggactggccgacggcaaacggggtacgcacccgtcggatgcggcccgctacgcggcgctggaggcttttgtcaatacgccggccgacaagtttctctcgaacaactcggcgaccggaaacgagacagaagacaaatcggacgaggaacgcgaaacgatccccgcgactatcggaatccgttgcatcaacgcaggggtgaagggcagactaggggtcacccgctgcaacgcgcatcacgagaagggccaactgctggtgagccatccgcagtatcgcgagttctacataggctatgccgccggcgacgacggtacgcctgaccggagccggccgatcgtcttcagtgtcaaccaggcacacgccgttatgcgccgcatcggcagccgggtagaaccagtgaccgacgacccgacgagtgtcttgcaggggattccgctcgggggctggggtgaccgcaagggatttttggcccagtggcgtgccgaactccatgcggtattcgagcaacacgggattgtccgttggtttcgggttggccaaggctgttacatcgagaagaccgacgggacggcgttccagttgtgcaacttcgacgaccaaaaggagtggatgaagaatggcccgttcaagaacatccagcgcgtctaccgctcgcccttacggggtgcggtggaaagggccaatccttgacgcggggtcgccttggccgccgtcggtcttcgacacgccgcgttcgaaggtgtaccaggccccgtccgggtcggcggcggccggcttgggctggtcgagcagttcgcacagatcgaggaaatgctgttgacaggcgctgcgttcggagagatttgcccgctgccacttggcgatgaactcttgcggcgtcatgtgtttgcaccggctggaagcgatcgggtgaaaaggccgattctatccgccggggatgcccgcgtccaggttgcccacgtccagcgtatcggtcccaacatgcccacgcaagcgtgggcatggcacccggccaggtcttgccgcgggactattgaagctccgacgccggattgtccggcgggatgccgcgggccgagtcgaatgtcggcaccgggcggaaatccgggcggtctatgaacgcgaggttcttccggccatagtacgaaccgtaatactgcccgttcgagtcgacccaggtcaccagccgaacccactcgcgcggcgagagtttcacgtcttcgtggccctcgcgcagcagggcaaggagcttgctggcgtgggcatacaagccgcgagccgggacgtagtggacgttgccggtcttggggtggttttcgccgatcaccttcaagagtccgtgccggagcatggtctcgtacgagacgctgaagtgccgggtcatggtcccgcgcaaatcgagttttgccttggtcttctggccgtcgtggcagcggacacagtgtttgtcgagaatcggctgcacatcggagggatagtggattgggcggccggccgtcttgtcgcccggctgcgggcccgggacaaccggcggacgactcatcgcgatcagcgacttcgacccgaaagccggcgtatccttggtcttctcgtggcagccgacgcaggcgcgggtttcccccggccggtagttcacgtacgtccgctccgactgcacggccatgtagtcctcgtcgagcgcctggaagaagatgttcttgtcggccgggacggtgaagtgggccgaaccgtcctcctcgaccggtacgatcccgtgcattgttttcaatcccaggtgcgcgtctttcgagacgaccgaatgctgctggtcgtaagtgtcgccttcccagaatcgccgggccttccacgggcgcgggacctgctccagcacgcggatgtacttgatcgacccccgctcgacgtcctccatcccgcggtagacgtcggcgacgatgacccgcgccagattttcgcgagccaagtcgggatcgaacgacgaattgggtaccggcggtttcgggcgggccgccaccggaatcggcatccagcaggagatctccgcatcgcgatagaacaactcggccttgccgtcggcgcccagcaggtacagcccgtacgccttggtgtcgttccacggctggtccgggttgtgcgcgacgaggaaccactta

SEQ ID NO: 128 - DNA, 3789 bp, synthetic construct
  misc_feature 1..3789: note = Synthetic
  source 1..3789: mol_type = other DNA
atgttgaacaagtgtttctcgtgagggtaaatgttcagttcgtaatggcgcatgttggactgtagttccagagctagttgtcgggcgtatttgacgctgtaaacttcatcttcttcgccgtgaaagatctgaacaggcggtaaacgcatgggctcataaggcattatccagggccagccgccgtagttccagatcactgccctaatcctgggatcgctgcaagcataggtcaaggctgcattggctggttgagaaaagcctgacagggcgatgcggctactatccactataggccaagcacaaagataatcaacgaccgccttgattgagttcaggtaccattcgagactgacaaaaagacgcgctcctactaccccctgattaatacttcccagtaaataaccaacacccctgtcccatgagtgtgggcttggggcaagccattcaggatggtttgaaggatctattaatacaacaacaaaatttcggttggcaagttgccggcagtaatcgtgaaactgggggacctgtgtcgctccgacgcccgccgcgacgataactgctggtgtaggactcacagagccttgcccttgcacgaaacaatagacaggcaatctctcaccatcatgcaatggaatcagagtcttgaaactgttgcccgaaccggcttcggagccaaggggaagagatatcagaaaagataagacccaccaaaagaacggtctataaaagtgtctcaacaagcgacctcagcaaaaaaattccaaaggcccatgatgcattgctccgccctattacggcagagggcccgaattcacatttcgtctctgctaccacaaaatagacataatttcaattggtaaggtcattgccttgcccttttgattttttgtcataagccagcttgtacgcaccttgtacgcaaatttcccgacttggattgcagcccttggtcgggattttctttattgccgtctgacaggaacctctgtttctccatggtcaaaagtcatttgatcaatcgcacagagtaactgctcgtctgagattcgaagatacctggcaacgagatcaggcaccaacttattcttgctatgcgtcttgggtcatgacgatagtctttcgaaaatacggggtcttctacgctaagaggcggtaattagttatccgatccgtttggatactggccagctatttgaaaaaccctcggaattgagcaacgactaaagccgtgtagtggctcagagcacgcaagacctcaacgacgggggctgtttggtggatggtctctacggagacgactgctataacagagtaatctcccctgaccgacttgatgggtcgattagtcttatattccatgagcacaacgccgggttggagaggccctaaccagacaggagtatctggtggtaggttcgcttttgcatcttcttctgaataaaatgtcaccttgccactatggctcatttcagtaggggctataagaacaacggatggaacccgatgcttgtcagcattactcagccactgaaggagtataagagcgtcgcggtctggagtactcatctcctcagacccatcccgctggaatggttgaaccagctcgattagctctcgagcggtatctggcatttgatcgagtttggcccgaccacttttctcaaacattgatctatcttgatagatagggaacgcgattgccgagggcttacttggtgggtcatgccgaagtcgcgagagtgcgaaggcaaggttgtcaagtgcactacggagattgtgaacacactcgcctataagaagtccccaatgatctattggggcattctccgcgaagtcctgcacaattaggcgaaaacctagcctcccctcggataactcacaccgagcagtagttggattgctagaaatccatgatgatatctgatcggtaagcgagcggatctggaaatcagcacgcgccagcttcagatcgaccgaccttattaagtcctgcattcgagatactgcaccgagttcgtacaatgattagatggtctgcataagccatgaaaaccagaccgtttccttctgtataggaaggtcccgcttcttcttgtacggtcttgtaatatcattcaaattaacgactgtccagattcgtgccccaaatacttcctaggcatcttggggcgatgtcgctcggcacgtcctgcttatttatctatccgaatttatacagattctcccacatatcccgctggtccagtgtcctacgcacctctgcgccagctcgccgaacaaaatcatttctccaaaaaatctgtgttcaatcgagaccgctttgggctaaactctacatgctccgtcccgaaacgtttctactgatactgtaacaggcagtcaacatgataaccctggctatagattacggtgcttcaaatgtgggtatagctctggtcagaaataccgaagcggggaatgaaccgctgttcgctggaactgttatcctcgatgctaggaagctgaaggaaaaagtggagacgagggctggcattagagggttgagaaggacgagaaagacgaagaatcgacggctcagagaacttggtgaagccctctcgggcttaggcatggagggagacaaggtcgccagaatagtccggttctcgaataggcgtgggtataagtctctgttttcagacccgaacgaaacggaaaaggtggacgaggctgaatcggcataccgatgcactagagaacagtttttccaccaactggaacaagaactgcaagagattctgagcgaccgtgaggcttgcgacaaagcactctccgtctgtgaaagaatactcaaccgcaagggggaccgatacgctgaaatcagattgataagaattgataatcggggagccagccgctgcgcatggggggattgcaacaaggtgaccccgaggcgggacaacgctactgacgatgcaattgcccagcaactggtcacgtattttcagagtgcaatcaagacggaaccccacaagcttgaaatgctcaaccaaacggtttgtgaactcgattcgatttccaagaatctccgaggggctattgcaaacaacgacgattcttcaaagaagatactgcgcaggagggcaagaaagagtctaagaaatcttagagccgagttaccaagcaccgaacctgaggacgtctcaggcgacgcgtggaagtatgtggaaaagggtattctgaacacccttgagaacagtggcggcaggaaccgttactgcagggaacacagcaagtcctacgtggaaaaagttctggaagggaagccaccagagttcaagtctaccattgcagattctgacattatttccagacgggaacagattgcgttcagcaagctctggagatacatagaggcgcgactgcttcctctcgctccgaagggaattgaccgaattgttgttgaacgaactgcgttcgaccttttagccggtaagcgaaagaaaattagagacgcctccagcgaaggtgtggaaaatatttatcagtacggccccatgtatgggttccccaatgaaaaggagatgctgcgaaaggaattcggagggctatgcgcttactgtggtaatccgtctgatacactcatggaccgagaccacatcctgccgaggcgagatttcttcttcgatagctatctgaacacactacccgcttgcccgacttgtaattcggaaaaatcggcgagtcttccttcccaggtctcacttcgaataagtgaggacgcctattcaatgtacaaacagtacc

SEQ ID NO: 129 - DNA, 5222 bp, synthetic construct
  misc_feature 1..5222: note = Synthetic
  source 1..5222: mol_type = other DNA
attggtttgcgccgccttgcgatcatagtaactgcgaaagcggctgttgaagcggcgtgccatctgagcagcctccgtaaatgcccaactcaaatagcgattgccgttttttcggttgccactgcctttgcttttgccgtcggatagccgttgggtggatacgcagcggcagtaagaggcaaaattgccgacgttagcaaaacggcggatgtcaccggcctccaacataatggtcatggccagaattttgccgatgccgggcactgtcagcaagcagttgaacgcttcggtgagctttacctgtttctggatggccgcctctattctgccaatctgctgtttcaaaaaaacaatgttgtccaaattggcctgcgcggacagaaccaagtgctcctcttttaaccatcgcttcagatcctggcctgttaccttgcgcagttgactggagctgactttttgaccacagcagcgcgcaagcagtgattgcaagctgaggatgtgagcagttctctgctggaccaagaacattcgtttgcgagccaagtcccgcaccggccgggcttctttgggataaatatagccttggggaagaatgcccaaaatcagcaactgggccagaaagaaggcatcgtgttgatcatcgctatgcttcaatccctcatattgcttaatggcggatggattggccagatgaacgcacgaatacccggcatccattataccgtctaccaaccagtaccaattgtatgtggactccaccaccaagccccggagtcggtcacgaaacggttccagtgtctgcaaaatgaggtcaaggtcattgcagacacgtttcttgaagatgcgattgaactgtgggtccagaaccccaatgtaggtgttgcttgaatgaagatctaacccggcgtataggctcatcgggcacctcctttggcttgggtggttagttggccttaaccgcctttagcaaatcgcgttctgttacgcgatgggaagtgccttttagatgattatcacgctatcgatacctcgacccacctcaggattcgtttgatttattttgcctattgcaacgggggcgggggctgcgatattatccaacatcaccgaagcgtcaaatctgtgatattttttcagccaagttgcatttttcaggaaagcaagaacgcgctggccaaagcgatggtaaaatgatggagtcatacaatgaaaaacaagggtgactgaccaattccccctcaccacgcgggatttctgtcttttattgcagtctttatcgagatgcgcgatcgcggaggcgttaccgccatatcacgccggggggccgggaacccctcccaacccaaccccctgtattataacggggggccggtacgaacggttgcaccaactcatgcctgccctttttgagaggaatctccttggccgctttcgattcatgccgggtctatggcgtgtgagttctggctgtttcagcatcaaaatgataacatgtaaaaagctttaacatgtattggcccctatccgcttcaaggtctgaaagatgccttcaacgctcgctattgacttcggctccaagtacattggtctggccttggttcataatgaagaggacggtcggaacacccctcttttcgcgggcacatttaagtatgacaaatttttcctaaataaaaaagttcaaccccgagcagccattcggcgggttcgccgtaccaggaaggccaaaaagacccggctgaaacgcctctatactgcattacttgcactccgggtaccccgagaacaaataccacccataatcaggttttgcgctcggcggggctacaagtccctgtgggagaccgacgaaaaatccggcggcgaaagcaagggcaatgacaatattgtctaccattatggccgcgaggagttctttgcggcgcttaaaaccaaattggaggacagcttgagcgagcaaaatgctcgcgattcactttcggcttgcgaacagattctgaactgccatggggatcccaaacttgagattcggccagtccgcatcgataaccgcggcgttatccgctgcgcttgggatggatgcaacaaggttacccccaggctgtccaatgccctgcaggacacgcttgcccatgtcgtattcacggtttacaatgaacgaattgcgaaagagcctcaactgcaggccgccattgtggcgatgttggatcgtattgccgatctcgggaaaagatatcagtcggtttcaggtgctgacccggctgctgagaaaaaagccttgatgaaacggatccgggccgaattcgcgatcctcaaacgttggtttgccgcatcgccagaaaatgaggatcaggtgagcaaatggaaatatatcaaaataaatcttaaaagcctgattacgcggcaagagggccgcaatcggttttgtcgcgaacacagtgccgagtatgtgcaacaccttctcgctgggaaaccaattcagttcaaggaaacgctgatcgagcgagatattgcatcgaggcgcgaggaaatcctcttccaaaaactttggcgctatatcgaggcaaggctgttaacgctcgtcccaaatcacatcgacagaattattgtcgagcgaaccgcatttgatctcttgacgggaacgcagaagcaacgacaaaagatgaccgaaaaaacattcgaagaaatgtatcaaagggggccgcggtacggatacacaaatgacctggaaatgcttaaaaaagagttcgcaggtctttgcgcctactgcggcagactatctgggcgtctgaccgagagggagcacatcctgccccaaaaggattttttctttgacagctacgttaacatcgttccggcctgcgacacctgcaatagtagcctcaaaggaaagctatctgggggcgccgttggtcttcgcattcatgatgctgcctatgaggcatattcaggctacctgcgctctaaatttaaaaccaacccgcctcatatttatcaaaggataaaaaagggcatactcaatctcatgaggcagcctgaccgcgtatgggaggccgagaactatctcgctcttatcagcaagcaacttgtcgaaactgtccaggcccagcgtacccccctaccactcgcccggtacatcggtggaaaattaagaaaggttcaggtgcagtcccccaagatagagttccgcagcggacgccacactgaaatttggaggagggccttgtaccctgaattcgataaacttcgagacagggaggatggcgggctactaaattacgctttggctgcgctaattatggcgagtgatctcccctcggttagcgctctcaaagcaaggcacctcaggctcaaggattggaacgagtggaaagccaatgtggtgacccgagcacctcgcgcggcgacctccggtatacctcacatcaagttgccgtttaccccagtgcccggtttcgaggagattatccccggaaattatctcattttggatctcgcactgttcaactggaattgtaaggatcgcgggactcataaacagaatccgttcggttggtgcggacccatgaattgtccttccaagcgcaaaaacgctgctgaattggtggcggaattctcgagaattgacaatatattagagactgccgatataaaacgagaaaagacttataagctcatcaacttggtggcgcatcctaatctccgagcgcatctgtttaaggttgttaactgcgaaacacccggcaaagcggcggctgaggcattgatggaatggttgcgggtttctgttaagaataccctcccgcactccccgatgagcaaccatccgggtgacagagctcggcattatgatctttgcaaattttccgaagggggagcggtacccagtgttatcggtatccgcaggcttttccccgaccgtgcagggaatgtcgacctatgtcgtgcaggtggtgaaaatgatggaattacgcatcgttatcagaccgatccaccaaacatcgggtatgtcttggcttatgcctccaaaaagggtatagtagatagaaaaaatccggttattcttgagatcaggcagagcggcgaattgcgcatccggctcggcaagaaatatttttcagaaagcggtgcggagcccctgttaagaggccgtattttaggccaggggaatgagattgactccaacaaatggtcgcaggcattaaaaaccaagctggccagaaacggcttggtcgagtatgggatcgttaccccagggtgcgtgctgaaatattttgataatgaagaattatttttgcgtaattttagccatgattacggatttaaaaattcaattttgaaaaatgtagtgggtataaagcggacgccgcttgatcagaaatttcgaaatttaatttcattgtcgtagtagcaatctactgttcgctctttggaaattttggatataacaggttgcggttgaaaagagcatcaactgcaaggtccactccgggatagggcagtttcggctcttggatttcccttggcgcaagctctgggaaaaaaccttgcagttcatgatgtgagcccatttttaattctgatgcatagttttaagcttattagccttaacggtaatggaattgttcaatctccgttacggcagtatttttcaactgtagcgaataggaaatatttcaatcaccctgttaaatctcttcgggttatattcctcgaagcttgcttcgataaaacggataaaatccctaatctgaaaaagaagaaacccgctactgcccggccatagtctccggtcgtcacccggagcgacggtcgacgacgatgatttcagctccgtgacgcagctccgtgctcatatcataatacatcttcattttaccaacaatgctctaaaattcaaaaactaattcatccattgagctcgaacaaaatatgaccatcctcggaaaaaagactttgggtataattgttaatgaaagcttgccaaagattacgtttatcggctgacagccgacccaggatgaacttatcgaacaaatcataccggatgatcacatgcgtgaatccattttcacgcaacattttggctaaagcctccgctgaagcgaccgatcggatacccgcatccagagtgccatcaaaaatcagatcccggtcacagtaatagcgccggtttcccaaaaagatacccaacacccgggcatctggcggcagatgacggt

SEQ ID NO: 130 - DNA, 4415 bp, synthetic construct
  misc_feature 1..4415: note = Synthetic
  source 1..4415: mol_type = other DNA
gtatattctttggagcgaaaaaccctgctaaaacctcgtactatgttcgcgtggacgatgatcccaggctgcttctcgtagcggacaccttgaaaaacagtgtcaacaagacggcattcgacctcagggacaagaccgtggttgctatagcgcctgaggacgtggaccgtctcgtcattgtacatgaaggaaaggaaaccgagctgaaacgacagacctccgacgcctgggaaatggtcaagcccgaggtcatgaaggcaaagagcagcctcgtcgaaggcagcatcaaaaccattaccgggctcaaagccactcaaatcatcgacaatcctgtcaaggacggcgatgaatacgggctggccaagtctgagacaagcatcgttctcgccggaccgaagctggaacaaacactactcgtaggtaaagcagtgtcatccgagaaggacaagaactcgcaggtgacgccggacagatatgcccgagtagcgggccgagacacggtgtacgcgatcgacggccggacggtgaagaatctcaagatcgaaccagacgcactgcgtgatcgctccttgttcgccctggttcccaccgatattgaaaagttcgagctggaactcgaaggaacgacctgggctgccgcccgtggcaaggacaacaagtgggatcttgaaaagcccgaaaagaaggacaaaattgaaacatggccagtgaccggtctactctggaccatcaaagacatcgcgtggaagtcgattatacgaccggccccggagaacctcgcctcagtccatcttgataagccgcggctcgtagccgccttctggaaaaagggggagaaggaccccaccgtcttcaaggccggttgggagaaaaccgcggctcccgcggcggacacgaaggctgctgataagccaagcgatgaaaaaaaggccaccagtgaggagaaggaagcaaaactgcccaagcccccggcggatgaaagtgaccaggcgcctcaattggtgaatgccacggtccagccgcattgggaaaaggacgcgatcttcgttctagacggcgccttcatcaagcgtctgcgcgatggtctgaaacgattggcggaaaaggagaaataggcgtggccgactgactagaccggctgagaaacgttccggcccgttcctcatggttttacgggtcacaacgccgccccatcgccctctcattgcgataagcgaaacgaagaagcaatcccgttccgtgacgggtcaatctaaggagattgctgtcctgcggtcgcaaggacaagctcgacacaaacttctttccacccgaaattgaaaaggtactgcacgcggaacctttccgttgacgcgggcctgcccccactgctatgctcgcgttcagacgcgctgcccctatgttcctgcactcggtcacgagaaagggggctctcagtcacatgataaccctggggatagactacggcgctgcctatgtggggatcgcgctcgttcggaaccatgagaacggacacgacgagcccttgtttgccgcgacgatggtgcttgatgcacgacgactgaaggaaaaggtcgaaaaccgggcggccttgcggcggttgagaaggacgagaaagaccaagaagaggcgtctgagagaacttaaggacaagctgcttcgcctgggacttgccccggaaactgtctcgcagattgtcaatttctgcgaacgacgcgggtacaagtcgctctttggccaagagggtgatcctgatgacaagtccagggacgagctaacctatcgcttcacgcgagaggaattcttccaaaccctggaaggtcatttgagccgccttcttctctcgcctgaggcgaagacggcagctcttgcaatctgcgaacgggtgctcaatcgtgccggtgaccgccgcctagaagttcgaccgctccgaatagaaaatcgcggggcgagccgatgcgcatgggagggatgtgacagggtcacgcccaggcgctccaatgcgatagaggatgcgattacccagcagttggtcacgtactttcagagcacgctcaagcagcaccaggatctgcttgacacacttaaggttgccactgctgaaatgggccgcatttcgcaccagttaagatcggccgtggaaaaaggactcgcccctgaagtcaaggctttgagaaagagagcccgagacgtactcaaacgacttcgcgtcgaattcacagaaccagaggcagccgaggagaacgacgaaaaagcctggaagtacgtcaaagaaggaattatgaacatcctggagaaggcccgcgggaggaatgcctattgcagagagcacagcgctgagtatgtccagacagtgttggcaggaagagctgtcccgttcaagaagaccattgccgagtgcgacatcttgtctcggcgcgagcagatagcgttcagtaagctctggcgctacatagaagcgcgggtcttgcccctggctcccgaagggatcgaccgcattgtggttgaacgtactgccttcgatgtccttgccgggaatcgccggaaaatacgcactacatccgagaagcgtgtcgaggagatgtaccaacaaggtccccggttcggtttcaaggacgacggggcgatggtgcgggaggaattcggaggcttgtgcgcgtactgtgggaagccttctcctgatttgatagagcgcgaacacgtcctgccgaggagagatttcttcttcgacagctaccttaatatcttgcccgcatgccccgactgcaaccggcagaagggccgcagtcgtccaggcagcgccgctctgcatatcagcgaagaagcctatgcgaactatgaccgatatctcaagaggatcgctggacaaaggccggtgcactttctccattacgagaaaaaaggaatcctcaatcttatgcgagatcccaagcgggcgtgggacgctgaacgatatctgggactgcttgccaataatttcgctgccatcgcgcaaagccagcgcggcccgcggccgtttgctcggttgctcttctcgaagctcgccgcgcgtcagaataagccccctaccataagtttcttcagtggacgccacacggccatgtaccggaccatcgcgtaccccggattcgagaaacacaaggacaaggccgaaggcggaacaatgaaccacgcgctcgacgcagtcctgcttgcgtgtgaactaccgaacgccagcgtactggaagcacgcggcatcaacgtccaggatttggaaacgtggcggcgcagggtccgttcccgtgcgccggttccggggaaggatggcgtgcccgatattcccctctatgaatggtgcgttccgggctttgaagaggtcggactcaatgggtacgtggaagtacaaatggccgccatgaattggaatcagaaggattcctcaacgcacaagcaagacccttacgggtggtcggaagaatcaaacaagccaaccaaaaggtcatctgcagtcgaactctatgaaaaacttatgaacgagaaggctgacgagaaggtgaagaacatcgtgcagactatacaccatccgtcccttcgctcggccatgtcacagggcttgaaagcccgtccccccggccccgcggttgccgaggccatgaaagaatggttgcgaaaatcagtacgaaatagcctcggcaagtcctcttgcacaagccaccctggggacctgaggaggaggacggatcttcagaattttgccgagaaccacgatgctaaaattccgcgcgttatcggcgtcaagcgactcgacacaggagttcaaggaaagatcgagctggagaggctcgatccaatgaacggcagaacgctccatcgctacatgagcgatccggtaaaccgggaagtcctcttggcttatcgcgtcgggtcaaatggacaacctgactttctcaaacccttcaccgtgaaggtgaaacaaaatttggctctgaagaccgacctgcgaacttttcaaccaattccccctgacttggcatgtggagtaacctggggctcggctgcgtcactcggggatggctggagcagcaagctggaaacgtatctatcggaacgcggcttttgtagctatgcgcggatcaagccatgctgtgtcgtctgctaccaggacggctcgcagctattcataaggaattttgacgataacaaggacttcaagccatcaaagatcctgaaaaacgtggttggggtaaagcgaacgccgtttgctttaaggatggtccccttaaaggtgttgacgccgcaacgtccgaagtgataagacacgggcaatcgttctttgacaaatcgcttcataagatcagtaggttgaaaagagcatccgtccgacatgcactccgggatggggcagtcccggctcttgcggttcccgatgcagttat

SEQ ID NO: 131 - DNA, 15300 bp, synthetic construct
  misc_feature 1..15300: note = Synthetic
  source 1..15300: mol_type = other DNA
gggggcgcgacgtggtgttgggcatcgcccgagacatcaccgagcgcaaggagctcgaacagcagctccagcaggcccagagactggaggtggtcggccggctctccggcggcatcgcccatgatttcaacaatctcatgaccaccgtcatcggcaacgcggagctcatcctcatgagcgtttccgaagacgacccggtgcgcgaggacgtgctcgaaatcaagaaagccggcgagcgggccgcgtccctcacccatcaactcctggccttcagccggcgccaggttcttcaacccaaaaccctggacctcaacagcgtggtgcaggagatggaccgaatgctccggcgcgtcatcggcgaggatatcgacctgcaaaccgacttggccccggacctgggccacgtggaggtggaccccggaagtcgagcagattctcatgaacctggccgtcaacgcccgggatgccatgcccgaaggcggcaaactgaccatcgagacggaaaatgtcgagctcggcgaagaatacgcccggtcccatgtcgccgtcacaacgggttcctacgtgatgctggccgtcagcgacaacgggatgggcatgacccgggatgtccaggcccagattttcgagcccttcttcaccaccaaggagctaggcaaagggaccggcctgggcctggccacggtttacggcattgtcaagcagagcggcggcaacatctgggtatacagcgagccgggtcagggggccaccttcaagatttacctgccccgggtggaaaagatggccagcggcccggagcggtccgagacggccatggaatctttccggggttcggaaacaatcctgctggtcgaggatgacgaaatgctccggaacatagccatcaagattcttaaaggacaaggctaccacgtgctggccgcgtcggacgggcgggaagccctggacctctgccaggaacacgatggcgtcattcatctcctcttgaccgacgtggtcatgcccgtcatgggaggcttggacctgtccaaccaggccaaaaggctgcggccgaacctgaaaatggtcttcatgtccggttacacggacaacgccatcgtgcaccgcggggttctggacaaaggcgtggccttcctgcaaaagcccttcacgcccgagcgcctggccaggaaactgagagaggtgctggcccagcggccttcgtgattgaaatcatcgccaacctcggctgcccgccgaactcactatcgggcctcggctcgaagtcctcgaatcgtaagggcgaccggccggtcgcccctactcggaatcctgtattttgctacggtctctaatggccgccgcgcggctgggttcaggtcaagcgcacccgcttggccttggccacgaattcctgtagattcgttctgaccgcgatcttgttgtatttgcccacgctggtcttgggtatctcgtccacaaaggccacgtacacgggcagcatccacttggtgatcttgcccttgtccactccctcggcctgaaggaacttcagcacgtcctcctcgaccgcgttgcttcccggcacgcgcttgaccagggccatggggatttcgccccacttctcgtccggcacgcccacgtaggtggcctcgagcacaaactccgcgttgctggtcaggttctcgagcaaaaccgtgggcaccatctccgagccgctgcggatgacatcggtgatccggtcggcgatggtgatgtagccgagttcgtccaccttggccgcgtcgccggtgtggaaccagccgccccgccaggcctcggccgtcctggccggttccttgtagtattgttccatgatccaatggccgcgcagcacgatctcgccgatggtctcgttatcgtggggcacgtcgtgcccgctctcgtcggtcacccgggcctcgatggccggcgacatggccaggccggtcttgaccatgacctggtcgattttctcctgaggccagaccgccatctcgcgtttgagcgcggcgttgatgacgccatcgaaggtctcggtcatgccgtagcccgagccggccctcatggacgggaagagtttttccgccttttgcttgagtcccaggggcagggccccgccgccgatggcgatgttggtcaggctggagaggtcccacttggcgatgtccttgtattcgaggatcatggccagcatggtgggcaccatggccgtgtggttcaccttctccctctcgaccagctcgcagaaagtctcgggcgtgaatctacccgggaagacaatcttggccgccgaaaacacatagtaaaacggcgcgccccaggcgtgaatgtggaacagcggcacgttcatcatgggcacgttctggttgggccgcggcggatcgtccggcagccgcacggccaggttcatcaaggccatgaggtggatggaatgcatatagacctggcggttcgtgtacagcgcgcccttgggcagcccggtggtgccggtggtgtaatagagcaccgcgtaggtgtcttcgctcatgtccggccaatcgtagattttgggctcgtccttgagcagcgcttcgtactcgtaaagcggcgcgatcttggtctccggcagtcccggctttacggacatatagacaaaggccttcactttgtccttgatgcggccatacagcgcctccaccagcggtttcacgtccgcgtcgaagaagatgaccttgtcctcggcatgggtgatggtgtaggccatgtggtccagggaaagccggatgttgatgggatgcgaaatggccccggaacagatggacgcgtagatgttctccatgtgccagtggtgattcaaagccatggtcgcgacccggtccccgggctgcacccccaggcgcttgagagcgtgggccaactggcaggtgcgctcgtgccactgccgccaggtgagccgcaggtactggccggcgtcgttccgatagaccatggcggtgtcatcgggatacaggtacagcggccgcctcatgaaattcctgagcagcaagggatagtgtttcgtgtactccgggtaaatggtcttctcggtcattttgcggtgtccctttctcgtgcggcctgcgcccgcaggcgatggttgccaggtgtccggctcggatggaagggtagccggtgccgttaacgccaagggttcatataatacaactctcaggctttacgcaagagttctgaggcccagtatttagttgtggaagaaagcgaaatctcgttgtcattgcgaggaagccgcaatctcgcgtaggggcgggtttcaaacccgcccgcattggagacgcgcccattgatgccatagggtgggcgggtttcaaacccgcccgcgcaaggtaccgtaaaagagactgaaattgttgtgtttcgcttcgctctatccaacctacagctttgcttcgctcgcagccacgcccttttcatatgacgccaaacttaaccaagtgttaggtcctggccgtatgcaaggcgcatggcccttgtctttcggctcggaaggcggcgaaaaaatccggcttgaccgggccgcgccatccttacatcttgacacaggccggcccttcccttatgctcccctggaaaaaagagatttattttaagcaaaccaatcggttatcaagcgactcgcgggtgagaaagaaagcagcatgaacatgcgtttgctggtggccaaccggggcgagatcgccgtacgaatcttgcgcgccgccgccgaactgggcatggccacaatggcggtgttcgccgaggacgacgcccaatcgcttcatattcgccgggcggaggcggcccaggccttgcggggccggggcgtttcggcctacctggacatggagcagctcttggccgcggccaaagaacacggctgtgacgccgttcatcccggttatgggttcctgagcgagaacgcggtctttgcccggcgctgccatgaagaggggctcgcctttgtgggaccggcggcggagacattggaactgctgggcgacaaggccaaggctagagccctggcccggcgcttgggtgtgccggtgctgcccgggaccgaacagccggtcagcctggatcaggcccgggcgttcctggcctcgctcggagacgaaggggccatggtcatcaaggccgtggccggcggcggcgggcggggcatgagaacggtgttccgcgcggatgaggtcgaggaggcatacacccgctgccgctccgaggcccggcagagcttgggcctggaccaggtttacgtcgaacaattcatgccccgggccagacacatcgaggtacagatcctcggggacggcgccggtggcgtaagccatttgtgggagcgcgaatgcagcctccagagacgatatcaaaagctgatggagatcgcgccctgccccagcctggccgagggtctccgcgccaagatcacggccgacgccgtccagctggccgaggctctgagttttcgcggcctgggaacctttgaattcctggtcgatgcgggcgaaaagccggacggggtcgggtacgcctttatcgaggccaacccgcggctccaggtcgaacacacggtgaccgaggaagtgaccggcgtggacctggtcaaggcccagctccgggtcgcggccggcgccgcgctgagggacctggggctcacgcaggcggacgtgcccaggccgcaggggtatgcggtgcaggcgcgcgtcaacctggagaccatggacagggacggtacggtgcggccggccagcggctggataaaatcttttgagccgccgaccggccttggcgtgcggacggacacctgcggatacgccggctatgccataagtcccagctatgacccgctgctggccaaggtgatcgggcattcccggtcgccaaatttcgccgaggccgtggccaggacctatcgcgccctgtgcgagttcaagatcgagggggtgcgcaccaacatcccgctcttgcaaaacttgttaaagcatccggattttgtcgccaaccgcatctacacccgctttgtcgaggaccacctggaagacctggccgccgaagacgccgcgcatcccaggctcttcgtcccttccccggaatcggccccgcgggcccgggccggggccaaggtggacgccatcgacccgctcgcggtcctggactacggcaagagcgaagaatttataaaacccccaaacgaaacggccccggatgaagaaccgccccaaacccacgactacgacatgaccggcctggaacacaccgtggccgtcaaggcgctcatgcagggcaccatcgtcagcatcgatgtccaggaaggagacctggtccgggagggccagcctctcctggtcatggaatcgatgaagatggaacacgtcgtcaaggccgaggtcagcggcctcgtggtccggctggccgtgtcccagggcgacacggtgtacgagggacaccccctggtctacatcgaggaacgggagctggagaccgaggaagccaagggaatggagcaggtcgatctggaccatatccggccggacctggccgaatccatcaggcgccatgaaatcctggaagacgccgcgcggccggaatccgtggcgctccggagacagaggggccagcgcaccgcccgggagaacatcgtggacctgtgcgatcccggctcgttcgtggagtacggcggtttggtcatcgccggccagcggctcaggcgttcggtggaagacctgatccagcgcaccccggccgacgggctcgtggccggaaccggctgcgtgaaccgcgacctcttcggcgaggaacgatcgcgctgcgtggtcctgtcttacgactacatggtcctggccggcacccagggcttgcagaatcacaagaagaaggaccggatgttcgagctggccgcgcggctgcgcctgcccgtggtctttttcaccgagggcggcggcgggcggccgggcgacaccgatcactcgatcgtggccgccctggacgtcatggcctttcacctcttcggccggctcagcggactcgtgcccctggtgggcgtcaactccggccggtgcttcgccggcaacgccgccttgctcggctgctgcgacgtggtcatcgcggcccggaactcgaacatcggcatgggcggcccggccatgatcgaaggcggcgggctgggcgtgttccgctccgaagaagtcggccccatgtcggtgcaggtgcccaacggcgtggtggacatcgccgtggccgacgaggccgagggcgtgcgcctggccaagaaatatctgtcctactttcaaggcccggtcgatcaatgggccgcggctgaccagaggctgctccggggcatcatcccggagaaccggctcaggatttacgacgtccgctcggtcatccagaccctggccgacacggattccgtgctcgagctcaggccgcactacggcctgggcatggtcacggccctcatccgcatcgagggccggccgctcggcgtgatcgccaacaatccgaagcatctctccggcgccatagacagcccgggcgcggacaaggcggcccggttcatgcagctctgcgacgcctttgacctgcccatcctcttgctctgcgacacgccgggcatgatggtcgggcccgaggtggaaaagacgggcctggtgcgccattgctgccgcctgttcgtgaccggcgggagcttgaccgtgcccttcttcaccatcgttttacgcaaggcctacgggctgggcgctcagaccatggccggcggcagcttccgggcgccgatcttcgtggtttcgtggcccaccggggagtacgggggcatggggctcgagggggcggtcaagctcggctaccgcaaggagctggccgcggtgcaagattccttggaacgaaaagagctgtttgataaaatggtggccgcctcgtacgaacgcggcaaggccatcaacacggcttcgcatttcgagatcgacgacgtgatcgacccggccgagtcccggcgcgtgatcgtgagcgcgctcaaggccgctcccaggccgcagccccgcacgggcaaaaagcgccccatggtcgacacctggtaatatacacaacgtcgttatatgatgcgcatgcagagcgtcggaacaaagcagaccaaggctgggcgaaggcgaggcatgaggcgtacttttcagtacgcttgagcgacgagccgaggagcaacacagggctaggaagttatggcgctctgtataatatccgccgaggcatcatcgccaggcatggcgagaaattaatagagaggagtcctgcatgacggaaaaaatggatggcctgctcagcccctatcgcgtcctggacctgaccgacgaaaaaggactgttctgcggcaagctgatgggcgatatgggcgccgacgtgatcaagatcgaacggccgggtggagacccggtccggaaccgaggacccttttatcatgacgaagccgatccggagaaaagcctttactggttcgccatgaacaccagcaagaggggcatcaccctcgaccttgaaaaaccccagggactggagattttcaagaaattggccaagaccgccgatttcgtcgtcgaatcctttccgccgggcaccatggacaggctgggcgtggggtacgcggacctcgagaagctcaaccccggcctcatcctggtctccatcgccccgttcggccagaccggcccgtacaaggatttcaaaggcccggacatggtcatgtgggccaccggcgccggtccctttatgcgcacctttgacagctacgaccgtccgcctttccgggtcagccaccacccccagacctatttccacgccggcaccgaggcggtcgtgggcgccatggtcgccttatatcaccgcggcaccagcggcgaggggcagcacgtcgacgtctccatccaggagtgcgtgaactggcacccctgcggcgactgggacttcaacaagagggtgcagaagcgtggcgcctttatgatccagatgaaggtcacggtcaagcacatctggccctgcaaggacggccacgtcatgtggcgctatacgggcggccccatggccaggcgacacagcatcccgctggttaaatggatggccgaggaaggcatggccgacgattggctgaagaatttcgaatgggacaagttcagccattacaacaccacccaggatatcgtggaccgcatggaagagcagaccgttcgcttcttcatgacccacaccaagacggaactgatgaccggggccatcaagtaccgcatcatgctctatcccatcagctccaccctcgacctggcggaaagcccccagcttaagttcagaggcttctggacccaggtggaacacccggagctgggcacaaccatcacctaccccggcaaatgggccaacaactcggaaaccccgccagtcatatcccgccgggcgccgctcatcggcgagcacaacctcgaaatctacggccgggaactggccatctcgaaagaatcgctcgaaacactcaaacgggacggggtcatctgatccgggctgttccaatacgagggagaacgaacatgggcaaactgccgtttgaaggaatcaaggtcgcggatttttgctgggtttggaccggcccgaccaccaccaaggtgctggccgacttcggggccacggtggtcaagatcgagagtcacaagaggctggacgtctggaggatgcagcccccgttcaaggacgacgtggtgggtccggaccgcggcgccattttcaattcgatcaacaccgggaaactcagcgtgaccctcgatctctcccatcccaagggcatcgagctggccaagaaactcgtggcctgggcggacgtcgtgagcgacaatttcgccggcggggccatgaagcggatggggttggggtacgaggtgctgaaacagatcaagcccgatatcatcatgatgagttccgccttgatgggccagaccggcccctggcacgacagcccgggctacggggaccaattgtcggctatctcgggcctgcacgagatttcgggctggcccgaccggccgcccggagagatcgggttctacaccgacttcatcgcgccgcgcttcaacgcgttgaccctgatcgccgccctggagtatcggcgccgcacgggcaaggggcaatatctggacatcgcccagcatcaggggggcgtgcaatacgtggcccctcttctgctggactatgcggtgaaccaccgcgtggccacccgggagggaaaccgcgacgcttacgcggctccgcacggaagctaccgctgccagggcgaggaccggtggtgcgccatcgccgtctccaccgaagaggagtggcaaagcttctgccgggtcatgggcgacccggcctggaccaaagaccccaggttcgccacgcttcaaaagaggcaggaaaacgaagaggagctcgaccggctggtgaatgagtggaccatgaacctgacggacgacgaggtgatgctgaagctgcaggcggccggcgtgggggccgggagaatcggcaccacccaggatcagatggacaacgacccccagctcaagttccgcaacttctaccaggaaagggaacacccggaactgggcaagtatcatcctccccggcagccgtgcgtcctgtcgaaaacgccctgtcagatcaaacgcgcccccctcatcggcgagcacaacgagtacgtcctcaaagaaatcctcggactgagcgacgaagagatcgaacccttgatcgtggaggaagtcattcagtaaaaatccggccgggggttgggaaaccatctccgggccggcgggacttcgaggccggggcgaggcgcgggagcctcctcccggcctcttttcatcaggcgacaaatgggctgaaccgcccttccagcgtttcatacttgaaatcatagcgccctctgcggtatcatcgctccaacccaagacatgctggtctgtgaagggaaaccatgcccgttacactggccatcgatttcggctcgcggtttatcggcctggccttggtgcgaaaccaagacggccacgacgaacctctgtttgccgggaccatcgcctacaagccttccgacctgagaagcaaggtcgtcgaccgcgcccagattcgacggattcggcgcacacgcaagacgaaacacgcccggctacggagcctcgagcatgggctgcggagcatcggggtcccgcctgaggcagtgcagagcattgcccgattcagccgccgccgcggctacaagtccctttggggggaagagaaggacgaagaaaaggatcaggatggtcaggaggaggaaaccctgtaccggttcagtcgggaggttttcttcgaggcgctggaggcggagcttttccgagtcctgcccgaggggctcatggcgcaggcactcgaggtctgcgcacgggtgctgaatcggcccggcgaccgccggctcgaggttcggcccctgcgcatcgagaaccgaggaaaaagccgttgcgcctgggagggttgcgagcgggtgacgccgcggcggcacaacgccctgcgggacacgctgtcccaggtcgtctataccaccttcaaggccgcggtggagaagcagccggagcttaggcaggagctggacggccggctggaccgcgtggccgagctggccaggcggtaccgcaacgcgggtggtgcaaatccagccgaggagcgcaaaacgctgctcaaaagaatccggacagagctgtcggccctgaagccgctggccaaaagcgccgagacgagggaggctgacgcggacaaggcttggcgctacatcaaggccaatctcgaggacatcatcaaaaagcagaccggccgaaaccgttactgccgggagcacagcgcggcctatgtctcgcacctgttggagggaaagcccattcccttcaaaccgaccttgacggaaagggacctcgtttcccgccagcaggaggttctttacgccaagatttggcgatacatcgaggcccggcttttccccctggcgccggagggcttcgaccgggtggtcgtggaacgcgtggccatcgaccttgtggccggctcgcggaaacagcgcgagaagctcggcgatgcggcgctggagaacctgtaccagcagggcccccggctcggcttcggcagcgacctcgagatgctcaaaaaagaattcggcgggctttgcgcctattgcggccagcccaaccctggactgattcagcgcgaacacatcctgccccgcagtatcttcttctttgacagctatctcaacctggtgccggcctgcccggcgtgcaaccagggccgcaagggcgcatccacgccaggaccggccgacctgcgcatccacgaggaggcttacgccgcttataccgcctacctggactcgatttccaagagcaagccattgcaccttttccatacgatcaaaaaaggactgctcaacctcatgcgggagccggaccgggtctgggaagcggaagcctacctggcgctggtggcgaagcattttgcgaccgcggtgcagagccagcgcggacctcggcccctggcgcggtacttgggcgaaaaactgagacagcggcaaggccggatcccaagcgtggcctttttcagcggccggcacaccgaggcctggcggcgggcctcttacccggactttgacaaggccgcggacaaggcgtccggcggccggatcaaccatgccctcgatgccctgctcctggcctgcgccctgccctcggtggccgcgctggaggcgaggcacctgcggagccgggacctgacagcctggaaacaggcggtgcaggcgaaagcccctcagcccggcccgatggggtttccggagctcccgaagttggtcaaaatcgtgccggggttcgaggagccgctgccggggaactacgtttcgctggacctggccctgttcaactggaaccggaaaaacacggccacccaccagcaagacccgttcggctggcaggcgcgaagcgacaccccggtaaaacggggcaaggcccaggacctggcggccgcgttggtgaaaatcgaccgggacaagaaggggtccctcgaggaccggcagaaggaagtcgttcggctgcttgaaaggctggcccatcccaacctgcgaagccatctcctggccggggcggccggggacgcgcccggggagcaggcggccgaagcgctcaagggctggctgcggaacgcggtggcccatagcctgccgcggtcgaagttttcgagccaccccggcgaccaggcccggaaaagggacctgctggcctttgccgagggcgcggcgccggacatcccggcaatcgtcggcgtgcgggaactcttcccggacgtgcggggcaaggtggaccttcaccggcgcgatccgcggaccggcggcatcctgcaccgttacatgaccgccccgtccaacatcgcgctcattctcgcctacaagcctgacagccgcggcggcgtgaaccggaaaaccccgctcctgctccaggtgcgccagagccgggccgtgaccgtgctgaaaggcgggcgctcgctcaagcccgtgccggacgggcctcttcagggccgcgtgctgggggacctgggcggcggcccgaagatggccgcatggctggaggcgtggacccaggcgctgcaagagtacctggccgtctgcggcctggccgaatacggcttcgtgtaccagggctgcgtgttgcaatacgaaaacggagaagaacggtacatccggaacttcagcccgaattacggcttcaagcccaagctcctccagaacgtgaccggcatccgacggtccccgctggcaaccgcgatcctgcctctggaaaggctggacagcggcgcgcaaagcggttaagatgcatcaaatggttctttgacaatggaatagccgtttcaggcaaaggctgaaaagagcgccggcctggcaggaccactccggaacgggcaattccggctcttggacccccttggcttaggctctggggaacatccctgcccggcgcgtcctttggacacggcgtgagccctatttttctttcatgctttaagggtgatgcgggccttggcctgtgcttctctgtcgtctcgaccccgatggaaccgtcattctggcgaaagccagaatccaggaatttgagttcaggtcaccctgaatatctcaacctcgttgagacggggcgctcccggcctcacggcttagggaatctcggtttcagtcaccctgaatatctcaacctcgttgagaccttttccggggcgttttccagaagcagtctcattcgtttcagtcaccctgaatatctcaacctcgttgagacatgacgatcaggccgaggccgaggcgttcatgggtttcagtcaccctgaatatctcaacctcgttgagacgtgatcgggcagcggttactcgtaatgttgttatgtttcagtcaccctgaatatctcaacctcgttgagacggctattccattttaccgaataaatccacccgattaaataggcggatgcgcgaaccccctgcctgtcggccccggaggagcgaccgcaaaccgcacctgggccgaaatttattcaaatcaaacggtctcaatagtgccgataggcctccacgtccggcacttccatggccccttccgggcacagctcgacgcagcagtaacaggcgatgcaatcgtcgctgatatgaaagtccggctcgagcgtaagggcgagggcgggacagttcaaggcgcaatccccgcactcgatgcatttttcatcgttgcgctgcggcttcaccccgatccgggtggccatcatgcccggcggatacagcttccgcatctcagcccggctttcttcatccagggcggcggcctgaaacgtggacggcatcttgaaatccgggatttttatcaagtcgccctggatgaccacgtcccgttcgtccagggcgcccagcccgcgggccagcccctccttttgaatgggcagaagcgccgggtccacgcccatcattctggccatgacgctgtccagggccagggcatcggtgctgccgagaagcttgcccacctttctcagccggcccccgtggcacggaccgttgccctcgatggcggtgatcgcgtccaggatgttcaggtccggcggccgcacctgaaagacgtcgcagaccgccctggcaaaaacctccggcgttctggccatgacgtgaagccgcgccttgcaggcgccggccacgtagccgaaggtgttcttcatggccccggtgatcatcatgccggcgtgggtcttgaaaatggggaggttgatgacgaagtccgcgtccagcacggccctcgagacgatcaagggcaggccggtcgccgcgccagtcctttccaccacctgctccgaaatgggaagaaagcggttctccgatgcgtccaggatgccggtgatcttggccacgttgcgggaactgcggttgatcccgcccgggttgtcgccgaccgccgggttcgcgcctcggtccaggcaggccagcacgaccgcgcgcaccagttccgggtgggtggtgtggcccagctcgggcggggacggcccgaccatgttgggtttgatgaggacccggccgccggcaaaggtgcgcggcgcgagccggtccatgagtcgctcgaccgtttctcttaagtcctgccccacattttcgatcatgacgcgcgatctatcgacttgagtcataagacactaccttgctatcgatggtttggatgccgtcatgatattttacccggtgcttttccgtcaatcccatttccttcttcacgcggaaagtttggccgcaacatggtcaattcctgccacggcgggtcatttgccatggggatagacccgctttgcccggggccggcgtttcatacttgaaatcccagagcccctgcggtaacatgcctcccatccaagacatgcaggcgcgtgaacggagaacatgtccgcataatgacggtcaaatgacctggatggaaatttcttggcggagaaggataaaaaactcaacgtcaacatcgggagggaaagagaaatgtcagtcgaagggaaatggaacttgaaaatccaaacacccatgggggagcagacgccgaccttgactctggcggccaaggggaacgcgctgagcggcacctttgccggcgcgcggggcacggcgaatttcgacgggggcacgatcgacggcaacaacatcgcttttacggtgaagatcgaggccatgggccagacgtt

SEQ ID NO: 132 - DNA, 5711 bp, synthetic construct
  misc_feature 1..5711: note = Synthetic
  source 1..5711: mol_type = other DNA
ctcgccgagaaacccaaaaggatcgagctgcacggctcgctgacaatcatcgcgggcggaaccccggaaatcatcgacctcaccaagcgcctcacaaccgtggggaaatcaaacgattcagacataaagtgctccggcctactggtgggcaagacggctgccctgatcaacaaacgacccaacggatatttccttgcctacagggagggactgaaaaagccggaagttaacggcgaagcggttcatacccaagtgcaactccaggacggcgacgaaatcaccatcggaaataccagaatgacgttcaatctgcgcgaagagatcctgtaagagttcgccgggaaaacaaattaaggtcaaggagggtcatatgccggtaattcagataaatctttttgaaggccgatccaaggaagaaaaaatagccatttgcagaagcattcaaaaggccatgaaggaggcgctatcaatcagccacgacaacttccatcatcgaattcgtgaatttgatgactcaactttgctgattcctccgggaagatcgaagaattacataatgattgaattaaacatgctccccggaagaaacgaaaccctcaaactcgacatgttcaggaaaatagaagcaaacttgcagcagttcaacattgctcaagatgacattcttatcatctgtcatgacccggcttcggaaaactggtatatcagggggaaaagcggaaaagaaatgcacaagaagtaattggggatagcagttcgcttactccgaggaatttcatctgtgccccgaaagggcaacccaacagtagccgtgggtgtaaacccacggaaaacggcacgacaacaccccgaaggaccctggcggggtcctcctcaatccgtccgaaaccgttgaatcttcggtccaccccttcagggtaggtgatccagggttatggtagtacttctggtccacgggtttacacccgtggctactattggtacgccccttcgaggctcagatttctcttttgacccaggtaaatgaatgctcacaaaatctccgttgatttcatttcaaacttcggctaggttcatcaatactgcgtaacctgttcgttcccttggccaattcctatcgctgctctgacgaaatcggagggcattatgtgaccaaatggccggatgtttctgcaagtcagagcccttctcagccaaattcgcgctgaaagcgcgaaggctaggattaaaatcaaatgattacgctggggattgattacggcgcgtcaaacgtgggtattgcgctggttcggaataccgatgagggaaacgagcccctatttgctggaaccatgatcctcgatgcaaggttgctcaaggaaaagagtgagaccagagcggcttggaggaggttgaggaggaccagaaagacaaagcacagacgactaagcgatttgaaacagcgtcttctgtctttgggatgtgattcggatctggccgctaaggtaatcaaattttgcgagagacgaggcttcaagtatagagacattgagaaactcacagacgaagaccttgcctacggaattccaagagaagagttctttggcagtctggaagctgagttggataggcttgtctcgtctacgcaactacgtgaaaaggtcctcaaagcttgtgaagaggttctcaaccgaaaaggcgaccctcggcttgaagttaggcccatcaggattgacaatcgtggtgtgaacaggtgttcgtgggaaggttgccccaatgttacgcccagacgggaaaatgccaccgtggatgccctcatgcaggcattggtcaattatttccagggagcgctcaaggaagatcctggtctcattgatcatgtgaaacaagctgtggaccatctcaatagaattgccaaaccgatgagagtggctgatgataaggatgccaagaccgaggtcaatagtctgcgtcgagaggccaggaaaatattgaggagtctcaggagtgagctgactgaagttgacccaacagacgagagggccgcgaagaaatggaaaggcgtcgagcaaaacattgtaaatatggtcaagtccggtgaaggaaggaatacctattgtagagagcacagcagtgagtacgtcagcagaattcttgccggcaaacccattgattttaagaaatccatttcggaggccgatattatctccagaagagagcagattgcattcagtaagatctggcgatacatagaagcgcggcttctccctctcgctcctgaaggcatagacagaattgtcgttgagcgcaccgcctttgaccttatcaacaagaaaaaaagtagaagaggaggcaagaataagaagccgaccccggatcaggacgggatgatagaggaaatctatcagatgggacctatgtacggcttcgagagcagaagggaaatgctcacgacggagtttgggggcctctgcgcttattgcggcaaggcatcaggcgaactcgtcgaatgcgatcatatccagcctcggagggatttttttttcgacagctatctgaacatcgtacctgcctgtccgcaatgcaatgccgagaagagcaagaggcgactcaaacacacgtcccttcatatcaatgcagaagcttatggaaagtatgacctttatctcaagagtcttagaaccaaggggcggcctctgcatttcctgcattacgagaaaaaaggaattctgaatttgatgcggaatccggaaagaaactgggaaactgatagatacctcggtcttgtcgcgaataatttcgccgccatcgtccaaagccagcgcgcccctcgtccgtttgccagattcctttactccaagatttcggctcgtcaagacaaggacccaaagattgacttcagaagcggccgccacacagccctctacaggactgtggcctatccggactttgataaggcaagagagaagtctattggcggcgctgtcaatcatgccctcgatgctatgctgctggcctgtctgctccctgatctccacaaattggaagcccgtggcatcaacgtccataacctgggcacttggcgaagatcagtcctgtccaaagctcccaaagccgctaaggacggagtgcccgtcgtacctgctcatggctggtgcgttccaggttttgaaattcaggatgaaaacggatacgtgtcccttgaaatggcttgcatgaattggaaccagaaagattcggcaacgcacaaacaagacccctatggatggtccgaacgggcaaggaagccaaccaagagagcgtctgcgatagaactgtatgagaaattcgtgaaggagaagaacgagggaaaggtcagaaatctggtcgaagatatccaccaccccgccctgagaatggctatgactaaggcttttgaggccagcaagtcgggtcctgccgttgctgaggccatgaaacaatggctacaggtgcaggtgaagaacagcctgagcagttcgagcttcacaagacatcccgcggaccagcgaaggaagcaagccctggaaaattttgcgcagggcagcgacacgaaaataccgcaggtcattggaatcaagaagttcgatcgaggagtcgtcggcaaaatagatttggtgcgcgaggacccggaaaccggcaagcccggacaccgctacatggctcatcccgccaccaaagaagtgatcctggcatatccggccgcagcaaatggaaaagcagacctattgaagccatacacggttgcagtgaagcagaatttttcgctcaggacccagggcgaaaggatatttaagcccaagccgcaggaattggaggaaggaatagtctgggggcgagatgcttcaccaacgcacggctgggaagataaatttgaaagatggcttttggaatgaggttttcactcctacaccctgcttacgcgtggatgcgtggtctgttacgaagatggaacacaatggtttatcaggaattttgacgacaacaaggactttaagaaggccaaaatcttgaaaaacgtcgtcggggtaaaacgaaccccttttgcttcaagagtggcgcgattaaaaatattgacatcgggaagtcaaaagccttaaaaacaaatacaccattgatctttgacaaatcgtttctcgaatcagttcaggttgaaaagagcatctgtctggcgagcactccgggatggggcagtcccggctcttgcggttcacgactcagctttgggtcgttggaacacatcgtcagacacgtcgtaagacaagatgtgagcccgtatttcttgcgtatctgaaagaaactttgagtttcaatcaaactgattaagccgttttcgttgcggcttcgggccgtatggagattatgccgcccatgctaagtttcaatcaaactgattaagccgttttcgttgcggcgcgtactgttcaggcccaaacaagcgccttcaatgggtttcaatcaaactgattaagccgttttcgttgcggcaaactgccgaccaccccatgttctcgccagtagttgtttcaatcaaactgattaagccgttttcgttgcggcatgatagaaccgtcatgtggatatcaactcaaagagtttcaatcaaactgattaagccgttttcgttgcggcaggcgtgggataggctttggaacaatgcgttatacggtttcaatcaaactgattaagccgttttcgttgcggcaataagggggtgattcctgtgaatgatggccagggtttcaatcaaactgattaagccgttttcgttgcggcaccgtaagcgatttgtcaaagaatatccctatattaggggggttgttttgcgaacccctctgttcgcggcactgaaaacacctcgaacagcgcccggtttttgccgtatggccgtacaactcttctaatttccaacggaaataatttggtgcgaacctccctctgaattggcggttctcgtaagaggcccaacccatcaagatatagtgcaaaatttgcacagcatcttgacgttgcgcgcttgagagcttcgggttcgcatcggagtgcctcttgtatgcccgaatgcgtcatgcgctctcctggaatgcggatcaaaaacccgtattgaccactccggtcccgcgctttccatgcgatctcctcgatgagcgcgccttgagcatgaagatgaacagcagcactagaccagtcaacagcatggccacgcccaatatttgttgaaaacgcgaagactcccgtttttcaggtctctcgggcttcctcggtgaagacgctacgatgttcttctgctccggacccaggctgatctccgacgaggccgacgcgatctgattgacatttatggaggaagcttcacgcggggccggcaggggcctggcgctgggattatcaaaaagcaaacggtagttctgatccggttgatacttgaataccgccatgcgaacagcagcgttggcaagaaacttgtctacggcaaccgctccacggctgccgcttgacagctcaagcttaagatagcgaaacgtttgcggtctgaaccgcgcctcaaggttctcctttacggcctcttccttgcggagacgaaatagggtgccttcgaatatgggcttccacgaatcggaagaaggcgtggatgccccgtaaacagtagctctcttgaggaattctgccgctgttgacgagacccgaacactgcctacaggaaatcgcttctc

SEQ ID NO: 133 - DNA, 7671 bp, synthetic construct
  misc_feature 1..7671: note = Synthetic
  source 1..7671: mol_type = other DNA
tcaattataggattagaactcaagaaaataatgggtgtgaaaaaggggcttatccatatggattggcccctttaattttttctggagcccacggacggatttgaaccgccgacccgctgattacaaaactaaatttaatgagttttctaaccccttgataactggtctggtttcccgtaagccattagaaattcaagggtaaattcatttcagtctattccagtctattctatctatttcagtctttttgattcaattcagtcacaatttagtcacaattctgtcacagtgcttttcggtttatcagcacgaagctcacccccatactatccctgttcagaccctgttcagataccatttccttcctgttgtagctttctcttccccaatctttggagatggtgtatatttcaatcaagagtaaataaactgacaaaaattgggcataaatggtaaattattaccattttccgctcacatttttaagagtcaaaataatatttatcattaaattcaaagcgttaatacaatcacatattatggtctgaatattgcttattttctgaatatcctccctatccatgtatgtatgttatttttttcttgacaagatattgattttttgctattagaccgctattcttattatagatgaattaagcccccatcgtcatacgtgacggtgggtaattaaatccccgccctcatacgtgacggcgggtttttattatacggagatgaaatgagtggcgagaaggtcatgatattcattgatggtagtaacttctaccataatttgaagactcatcatttcaatacaaatattgacttcaaaaagtttagcgacttgctctgtagaggacgtaaacacatcagaacctattattacaatgccccattaaaacaggcagatggccgtgaagagtatagaaagcagcaattattttttgatggtctcaggagaacctcatatcttgagttgaaacttggatattttttgaagaaaacaaaaacctgtgaagggtgcggtcatgttttgaattatcctgtcgaaaaagggtgtgatgttaatcttgctgtggatataatgagtatggcgtataagggtctttatgatgtggctatcttggttagttcggatggtgatttttcaagtgcttgtcaatgggtcaaggaccttggtaaacatgttgaaaatgcctatttcgaacagggaagttcgtggcatcttttgaatgtatgtgatgaccgtattctcatagaccaagattccattgacaagtgcatccggttgtaagctattttgagtgaagcataccttttactgcggactaactccctcccttccgctccgaccctcaaggtttagtgccggaatttataggcaaccacctttccaattcttattgacattttgttcccgttttcatacactctcatctaaattggagccctccattattaacccctaacccgttgggtgggtatgcagtcccgcgtaacactttctgtagattttggttataaaaacatcggccttgctttggtgaggaaccaggaaggaataaatactcctctgtttgctggaactatcctttacgacccctatcaactcagcacaaaggtaggaccgagggcagcactccgcagaggtcgcaggacgagaaagacaaagagacgccgcctaactcttttaaaaaggaaactgtttgctataaatcttcctgaagaaacaattcagcaacttattaccttttgcagacgccgaggatactcttccctctttgatgaacctcaaaaattgggccaagaagccaaggactcaaaagaggaaattgtttttcgtttcagtcgagaagagttttttgaagcactggaaaagcagatagataaactggtccccgatgaaaaaagggggttaaccctcagtatatgcgaaaacatccttaaccgagcgggtgatccctccagagaaatccgacaaataagaattaacaaccggggagcctcccggtgtgcctgggatgggtgcgagaatgtaacgcctcgccgggacaatgctcttggggacccgctatcccagttcgttcatacggtatttgccacaaccctcaggggtgacgaaaccctccaacaaggagtctcccaaatgttggaccgcatcgcggtattgggaaagcggctccgacatcgtggaggtcctaatccggataaagagcgtaagactctcaaggcaaaaatcagcgatgaactcaagctattaaagaagctgtatggcctaaaccctgatttgacagaagagaccgctactccatggacaaagattcgtcagaacataacgaacctgattgaacagaccggaggccgtaaccgcttctgtcgttaccacagctctcaatatgtcacccacttcttggaaggaaaaccgatacccttcaaggcaactttgacggaaagggacttggtatcccgccgggaagaaatcctctttcaaaaactatggcgttatattgaagcaagagttcttccccttgcccctgatggcattgaccgtgtgattattgagaggacagctttcgaccttcttgggggaagccgaaaacagcgtcaggggattataaataaggaagcccttgaggagatgtatcagcatgggcctcgatacgggttcgggaatgaccttgaaatgctgagggctgaattcgatggtctgtgtgtgtattgcggcaagccaaatactgaactgcttgaaagagaccatcttctcccccagtccaaatttttcttcgatagctaccttaataaagttcctgcctgtccgccctgtaatcggaacttaaaacaagccgcctccccaggaggggcttcactcaggattcacgaagaggcatacgatgcctattctaaatatgtggcttccaagtttagggttaaacctccccatctgtttcataccatcaagaaaggtatcctcaatctcatgcgagaacctggtcgcgtctgggaggccgaacggtatctcaaccttatcgccaaccagtttgcccaggtagtggggacccagagagggcctcgtccccttgcccgttatctaagcgggaagatttaccaaaagttcggggaaaagccaaagattggatttgtcaatggaagacacacctttctatggcgaaaggctgcttatcctgaattcgataagtatagagagaaaaaagagggcggtgtcatcaaccatgccttggatgcccttctgatggcttgtgacttgccagacctgaccacccttgaagcaaaaaacttgcatcccggtttgatgcattggtgggtcgataaggtgaggaaggctgccccacctgaaggtgctgatgggataccagtaatacctgaaccacggtttgccatagatggttttgaaaaggttcatcctggaaactatgttgaagctgatttagcaaaaatgaactggaaccacagggattctcaggttcaacgccaaggagcctacggttggtcaaaacagagggacattcctactcagcgtgttacagccgcgagcattgcggatgaacttcgtaaggctgacaaaaaaacatctcctgaatcaaggaaggccgaggtcgataaaatagtggatgggattgttcacccacaacttcgtaaaatcctgaaaggagcaaatactggagatacaccgggtgtaaccacagcaggggcactaaatatttggttacggaaagcgatcaaggggaacttaaacaaatctcaattttctcctcatcccgcagaccaatccaaggctaaaatgcttcagaatttcattacggccgaatctgacgtaatcccttcaattatcggtgtccaaattctctatccatggcttaaatccaacatggacttaaatcgagtcgcccctaaaaatggtcgccttgtgcatcggtatgtcgctgatccagcaaatgttgcttacatagttgcctatcgaaaaagtaatggcgtggtcaagcgagagaagcccctaacgcttgaatggcgtcaaagcggggctgtaattcctggtgtcaaattgtttggagatattcccgaggggccattgaaaggacgtccatttggcgagaaagccatcgaccataaagagtggaaaaacgctttgcatcgatacctgtctaacgcaggaatagccgaatataactttgtgtcacaagggaatgtggttgtttatgaggatgggaaggaatactatattaggaatttttctggaagctatgggtttagaaaatccttgttcaagaggataaaagcggtccgaccttcaccgctgacacagcgattgattccaaacgcaatagtttagaagctgtgattctgttctttgacaactggatagcgtgttcgggttcaagctgaaaagagcatctgtccggaaggaccactccgggttagggcagacccggtacttggacctccttggtcttttagactctggaggaaacctccggcgtgtcgtaagacaagatgtgagcctatttaaaatctatttatcatgaattaatctaccagtcaccctgaacttctcaactccgttgagacctggtcccttatctgtcgtcggatagatggggagtttcagccaccctgaacttctcaactccgttgagacatagtcaaggtctatcgctgataggagaaaggtttcagccaccctgaacttctcaactccgttgagacacaggcagttgtagatttggaggttaaagagcatgtttcagccaccctgaacttctcaactccgttgagacctatgagcgaaaaatatgcctgtagctatgcttggtttcagccaccctgaacttctcaactccgttgagaccaggataaagctctttgtgaaagcatccataagggtttcagccaccctgaacttctcaactccgttgagactgctatccaaaactcattattttttaagggtagatggaggggtgtttccgcgaaccctgtcctaattagtttttgagtcgatccttctgtttacccgttcacggtaactcccgtgaattattaataaatagatagatcgcgaaacccctacgctttgggtggttactggtggttcgcgaattgttggacccttacttacatcatcggtaaatgggagtgaaagatggaatctgtagttaggacaaaaaatgttagaagggcagaggcaattttacggtatatcattgggatcattttaatcatttttgctttttctattgaagggattttgcgttgggtaatcggattgatcggcgtggcatttattcttacgggcatatttggatactgaccctgaaaagggtttatgctgaaggtcttcagcaaataatgcagataatttgcccgtaatccatgacagaaaattagcctccctctacgcaaagaactggcaagaccacgctcaacattcggaggtctattccggtagaagtcggtagaacttgatggaacattcctcaatgcagagatcatcaagcaggcatatggatttgcttacactgggttctctttaagtatgtggaggagttcggacgggaagaaaggaagtgtgaaaagatgagttgggatggtaaagaatgggtagagctttcgataggtaaaaagactgagcttgtaattacaataattttagccataggaatatgggtgcttggtattatctattccccactggcaaggatgttaattgctggtgcaggattaattggattgggacttttaatagctaaaattcgtcagccaacaccgacagttcttgcttacttgtgctttgctctgtggggagtcggagggcttcttttgctaatcgctataatcaaatgggctaattggtatatggggttccgaataggttattgaaaacttgtggagagagaagtattcaccaaggaggagtttttggagatggtgaaggtagtggatcgggagatgaatagaaaaagagaaatgtaggaggaatgaaatggattttaaggaacagacaattattgaatatgtaaaacattgtcaagaagattattctaaaggacatgacctctacaaagagtattcaaaaaaaatggagaaaaaaggcttggaaaacttcgatgaaataaatcatgttgagatgattataaagccttatctgtataaatggggaagaatgcagcgagtgcttggacaaaaacaatacagaggatgggaaagtgatattgttgagcaggttcggctaaattttgacacacttgaaaattttagaaaaatgaaattcgaatcttcaaacctcatcgatcataaaacaaatattataaattgttatgaatcctttaataagattgtggatggcgtggcagcagcaaaggttcttcatataatttctccatacttcttccctttgtgggataatggtatatcagtgatcgtaagaaaagaacgtgtaagagccgcaattagtaatgaaggatttttaatagatattaaagatttttcaaacaaaattgaggacttttcgggaaaagattacttttattttatgaaaatattgcaaactattcttgagaaatataaaaatactttttccgttttggcaaaatcttatgaaaaaggagtattaaagattatggatgattttttgtggatgttggttcatgaatcactctgtatatatctttaaaaattatggaaattaatatatggaaaagaagaccaaaggaaagtctttagagatagggaaggtgacaaatcgggagacgaagaaagaaaagtgaaatgaaaatttacctaacccattgctcatccaagaaggataattcaataaaaaatactggtagaaaagtaactccagccaaattgtacaagatcatagggtcaggcatcggtaattcggtattgacaacgcagagaacattcatccttcaaattcgtccccacttgaagaacggatggtgtatggcgaggccattatacgccgatatctggtattctgcgtatcactcgattggaggggctccatggacagattattttttagggcctttagaggcccgagggaaattggagcccacggacggatttgaaccgccgacccgctgattacaaatcagcagctctaccactgagctacgtgggcatacttaacgtgtacgtaacacttttgtgtccgtcaattaaaaaccttcatatttttaccacatattttcagcaggatcaaatgctgcaatcctttcgaccattctttcactcatccctaccttcacccatcagagattgtttcacacttcgccgtttccccttcgacacgctaagcctgccccccgaacaaggtctttggcaggcgggggcgaacggccctgcctgccaaaccatgaacggatttggagcacatcctctcaaaagggaggggaattagggatattacttcccttcctcatctttccccaacagctcatcggaaattaaaatacttattagccatgtcaatggcagccggttttccttatttcggtcctgccagcagaaaaacgatggtccacccaaagaggaggactataaaagtgatgaactgtctgaccaatttgggatccataagaactccttctctctagagattgagatagattgccttttttcagaagatgatgtattgaacatgta

SEQ ID NO: 134 - protein, 5 aa, synthetic construct
  REGION 1..5: note = Synthetic
ASSHN

SEQ ID NO: 135 - protein, 10 aa, synthetic construct
  REGION 1..10: note = Synthetic nuclear export signal
  REGION 2..4: note = misc_feature - Xaa can be any naturally occurring amino acid
  REGION 6..7: note = misc_feature - Xaa can be any naturally occurring amino acid
  SITE 9: note = misc_feature - Xaa can be any naturally occurring amino acid
LXXXLXXLXL

SEQ ID NO: 136 - protein, 4 aa, synthetic construct
  REGION 1..4: note = Synthetic endoplasmic reticulum localization/retention signal
KDEL

SEQ ID NO: 137-139 - skipped (3 entries)

SEQ ID NO: 140 - protein, 5 aa, synthetic construct
  REGION 1..5: note = Synthetic
TEFCA

What is claimed is:

1. An engineered nucleic acid targeting system comprising:
a Cas polypeptide comprising a RuvC domain and an HNH domain, wherein the Cas polypeptide is about 950 amino acids or less in size,
an engineered guide molecule comprising a guide sequence and a scaffold and capable of forming a complex with the Cas polypeptide and directing sequence specific binding of the complex to a target polynucleotide, and
wherein the Cas polypeptide is encoded by nucleotides 9364-12198 of SEQ ID NO: 99, nucleotides 9364-12198 of SEQ ID NO: 100; nucleotides 10001-12841 of SEQ ID NO: 101, or nucleotides 1597-4407 of SEQ ID NO: 126, or has at least 90% amino acid sequence identity to the Cas polypeptide encoded by nucleotides 9364-12198 of SEQ ID NO: 99, nucleotides 9364-12198 of SEQ ID NO: 100; nucleotides 10001-12841 of SEQ ID NO: 101, or nucleotides 1597-4407 of SEQ ID NO: 126.

2. The engineered nucleic acid targeting system of claim 1, wherein the Cas polypeptide is operably coupled to one or more nuclear localization signals or nuclear export signals.

3. The engineered nucleic acid targeting system of claim 1, wherein the Cas polypeptide comprises one or more mutations that modify a nuclease activity of the Cas polypeptide such that the Cas polypeptide is a nickase or is catalytically inactive as compared to a Cas polypeptide lacking the one or more mutations, wherein the one or more mutations inactivate the RuvC domain, the HNH domain, or both.

4. The engineered nucleic acid targeting system of claim 3, wherein the Cas polypeptide has at least one mutation in the RuvC or the HNH domain that renders the Cas polypeptide a nickase, or has at least one mutation in both the RuvC and the HNH domain that renders the Cas polypeptide catalytically inactive.

5. The engineered nucleic acid targeting system of claim 3, wherein the Cas polypeptide is operably coupled to one or more functional domains.

6. The engineered nucleic acid targeting system of claim 5, wherein the one or more functional domains have one or more activities selected from deaminase activity, methylase activity, demethylase activity, transcription activation activity, transcription repression activity, transcription release factor activity, histone modification activity, nuclease activity, single-strand RNA cleavage activity, double-strand RNA cleavage activity, single-strand DNA cleavage activity, double-strand DNA cleavage activity, nucleic acid binding activity, transposition activity, reverse transcription activity, or a combination thereof.

7. The engineered nucleic acid targeting system of claim 1, further comprising a deaminase or catalytic domain thereof.

8. The engineered nucleic acid targeting system of claim 7, wherein the deaminase or catalytic domain thereof is an adenosine deaminase or catalytic domain thereof or a cytidine deaminase or catalytic domain thereof.

9. The engineered nucleic acid targeting system of claim 1, further comprising a reverse transcriptase or functional domain thereof.

10. A polynucleotide comprising one or more nucleic acid sequences that encode one or more components of the engineered nucleic acid targeting system of claim 1.

11. The polynucleotide of claim 10, wherein the polynucleotide is codon optimized for expression in a eukaryotic cell.

12. The polynucleotide of claim 10, wherein the polynucleotide is mRNA.

13. A vector system comprising one or more vectors comprising one or more polynucleotides encoding one or more components of the engineered nucleic acid targeting system of claim 1.

14. The vector system of claim 13, wherein one or more of the one or more vectors are one or more viral vectors.

15. The vector system of claim 14, wherein the one or more viral vectors comprises one or more retroviral vectors, lentiviral vectors, adenoviral vectors, adeno-associated viral vectors, herpes simplex viral vectors, or any combination thereof.

16. A delivery vehicle comprising an engineered nucleic acid targeting system of claim 1, or a polynucleotide or vector encoding one or more components of the engineered nucleic acid targeting system.

17. The delivery vehicle of claim 16, wherein the delivery vehicle is a lipid nanoparticle.

18. A method of modifying one or more target polynucleotides, the method comprising contacting the one or more target polynucleotides with an engineered nucleic acid targeting system of claim 1, wherein the engineered nucleic acid targeting system is directed to the one or more target polynucleotides by the engineered guide molecule of the engineered nucleic acid targeting system, whereby one or more target polynucleotides are modified.

19. The method of claim 18, wherein the one or more target polynucleotides are modified by
   a. insertion of one or more polynucleotides;
   b. deletion of one or more polynucleotides;
   c. conversion of a C•G base pair to a T•A base pair;
   d. conversion of an A•T base pair to a G•C base pair; or
   e. a combination thereof.

20. The engineered nucleic acid targeting system of claim 7, wherein the deaminase or catalytic domain thereof is operably coupled to or is capable of complexing with the Cas polypeptide, the guide molecule, or both.

21. The engineered nucleic acid targeting system of claim 9, wherein the reverse transcriptase or functional domain thereof is operably coupled to or is capable of complexing with the Cas polypeptide, the guide molecule, or both.

* * * * *